United States Patent 10,226,489 (COMPOSITION OF BACTEROIDES THETAIOTAOMICRON FOR IMMUNE MODULATION) - sequence listing, part 3

SEQ ID NO: 1 - DNA, 6574984 bp, Bacteroides thetaiotaomicron (residues 3,287,493-4,931,238 of 6,574,984)
  modified_base (3086269)..(3087366): a, c, t, g, unknown or other
  modified_base (3089801)..(3090739): a, c, t, g, unknown or other
  modified_base (3091393)..(3092429): a, c, t, g, unknown or other
  modified_base (3106348)..(3107421): a, c, t, g, unknown or other
  modified_base (3107552)..(3107552): a, c, t, g, unknown or other
  modified_base (3113768)..(3114749): a, c, t, g, unknown or other
  modified_base (3115110)..(3116153): a, c, t, g, unknown or other
  modified_base (3117671)..(3118702): a, c, t, g, unknown or other
  modified_base (3118837)..(3119841): a, c, t, g, unknown or other
  modified_base (3120490)..(3121433): a, c, t, g, unknown or other
  modified_base (3121700)..(3122759): a, c, t, g, unknown or other
  modified_base (3124187)..(3125199): a, c, t, g, unknown or other
  modified_base (3125625)..(3126715): a, c, t, g, unknown or other
  modified_base (3126925)..(3127959): a, c, t, g, unknown or other
  modified_base (3130399)..(3131477): a, c, t, g, unknown or other
  modified_base (3131746)..(3132762): a, c, t, g, unknown or other
  modified_base (3132924)..(3133929): a, c, t, g, unknown or other
  modified_base (3134295)..(3135398): a, c, t, g, unknown or other
  modified_base (3136185)..(3137244): a, c, t, g, unknown or other
  modified_base (3137388)..(3138353): a, c, t, g, unknown or other
  modified_base (3139288)..(3139288): a, c, t, g, unknown or other
  modified_base (3164719)..(3165785): a, c, t, g, unknown or other
  modified_base (3165929)..(3167041): a, c, t, g, unknown or other
  modified_base (3178834)..(3178834): a, c, t, g, unknown or other
  modified_base (3178981)..(3180054): a, c, t, g, unknown or other
  modified_base (3213054)..(3214095): a, c, t, g, unknown or other
  modified_base (3266722)..(3267701): a, c, t, g, unknown or other
  modified_base (3268983)..(3270063): a, c, t, g, unknown or other
  modified_base (3270469)..(3271515): a, c, t, g, unknown or other
  modified_base (3271706)..(3272840): a, c, t, g, unknown or other
  modified_base (3272988)..(3274104): a, c, t, g, unknown or other
  modified_base (3274257)..(3275337): a, c, t, g, unknown or other
  modified_base (3275556)..(3276608): a, c, t, g, unknown or other
  modified_base (3282524)..(3283610): a, c, t, g, unknown or other
  modified_base (3309481)..(3310560): a, c, t, g, unknown or other
  modified_base (3310731)..(3311764): a, c, t, g, unknown or other
  modified_base (3312164)..(3313150): a, c, t, g, unknown or other
  modified_base (3322229)..(3323308): a, c, t, g, unknown or other
  modified_base (3323479)..(3324477): a, c, t, g, unknown or other
  modified_base (3324954)..(3325979): a, c, t, g, unknown or other
  modified_base (3331465)..(3332451): a, c, t, g, unknown or other
  modified_base (3372880)..(3373968): a, c, t, g, unknown or other
  modified_base (3374982)..(3376085): a, c, t, g, unknown or other
  modified_base (3376261)..(3377274): a, c, t, g, unknown or other
  modified_base (3377709)..(3378867): a, c, t, g, unknown or other
  modified_base (3380356)..(3381433): a, c, t, g, unknown or other
  modified_base (3382279)..(3383294): a, c, t, g, unknown or other
  modified_base (3388698)..(3389726): a, c, t, g, unknown or other
  modified_base (3390087)..(3391062): a, c, t, g, unknown or other
  modified_base (3392624)..(3393662): a, c, t, g, unknown or other
  modified_base (3394313)..(3395258): a, c, t, g, unknown or other
  modified_base (3395495)..(3396471): a, c, t, g, unknown or other
  modified_base (3432253)..(3433234): a, c, t, g, unknown or other
  modified_base (3433484)..(3434578): a, c, t, g, unknown or other
  modified_base (3446168)..(3447101): a, c, t, g, unknown or other
  modified_base (3448344)..(3449342): a, c, t, g, unknown or other
  modified_base (3449662)..(3450667): a, c, t, g, unknown or other
  modified_base (3450944)..(3451993): a, c, t, g, unknown or other
  modified_base (3452251)..(3453250): a, c, t, g, unknown or other
  modified_base (3478003)..(3478957): a, c, t, g, unknown or other
  modified_base (3479220)..(3480217): a, c, t, g, unknown or other
  modified_base (3494115)..(3495115): a, c, t, g, unknown or other
  modified_base (3506325)..(3506504): a, c, t, g, unknown or other
  modified_base (3513395)..(3514419): a, c, t, g, unknown or other
  modified_base (3517779)..(3518778): a, c, t, g, unknown or other
  modified_base (3519082)..(3520021): a, c, t, g, unknown or other
  modified_base (3562326)..(3563267): a, c, t, g, unknown or other
  modified_base (3597338)..(3598433): a, c, t, g, unknown or other
  modified_base (3598774)..(3599803): a, c, t, g, unknown or other
  modified_base (3629452)..(3630436): a, c, t, g, unknown or other
  modified_base (3635887)..(3636772): a, c, t, g, unknown or other
  modified_base (3637126)..(3637126): a, c, t, g, unknown or other
  modified_base (3637480)..(3638348): a, c, t, g, unknown or other
  modified_base (3639828)..(3640883): a, c, t, g, unknown or other
  modified_base (3648231)..(3649236): a, c, t, g, unknown or other
  modified_base (3651864)..(3652922): a, c, t, g, unknown or other
  modified_base (3657906)..(3658902): a, c, t, g, unknown or other
  modified_base (3659285)..(3660310): a, c, t, g, unknown or other
  modified_base (3678408)..(3679474): a, c, t, g, unknown or other
  modified_base (3749882)..(3750948): a, c, t, g, unknown or other
  modified_base (3753169)..(3754209): a, c, t, g, unknown or other
  modified_base (3782813)..(3783835): a, c, t, g, unknown or other
  modified_base (3784945)..(3785978): a, c, t, g, unknown or other
  modified_base (3790071)..(3791160): a, c, t, g, unknown or other
  modified_base (3800843)..(3801756): a, c, t, g, unknown or other
  modified_base (3802212)..(3803250): a, c, t, g, unknown or other
  modified_base (3811732)..(3812710): a, c, t, g, unknown or other
  modified_base (3847664)..(3848698): a, c, t, g, unknown or other
  modified_base (3854789)..(3855853): a, c, t, g, unknown or other
  modified_base (3858039)..(3859049): a, c, t, g, unknown or other
  modified_base (3860560)..(3861590): a, c, t, g, unknown or other
  modified_base (3870133)..(3871139): a, c, t, g, unknown or other
  modified_base (3879481)..(3880446): a, c, t, g, unknown or other
  modified_base (3901161)..(3902080): a, c, t, g, unknown or other
  modified_base (3907873)..(3908882): a, c, t, g, unknown or other
  modified_base (3918385)..(3919305): a, c, t, g, unknown or other
  modified_base (3935681)..(3936577): a, c, t, g, unknown or other
  modified_base (3969457)..(3970358): a, c, t, g, unknown or other
  modified_base (3972432)..(3973409): a, c, t, g, unknown or other
  modified_base (3975855)..(3976838): a, c, t, g, unknown or other
  modified_base (3984840)..(3985859): a, c, t, g, unknown or other
  modified_base (4058825)..(4059845): a, c, t, g, unknown or other
  modified_base (4060683)..(4061676): a, c, t, g, unknown or other
  modified_base (4065213)..(4066324): a, c, t, g, unknown or other
  modified_base (4073969)..(4075026): a, c, t, g, unknown or other
  modified_base (4103704)..(4104683): a, c, t, g, unknown or other
  modified_base (4120806)..(4121757): a, c, t, g, unknown or other
  modified_base (4140620)..(4141640): a, c, t, g, unknown or other
  modified_base (4143858)..(4144882): a, c, t, g, unknown or other
  modified_base (4150214)..(4151156): a, c, t, g, unknown or other
  modified_base (4152422)..(4153371): a, c, t, g, unknown or other
  modified_base (4187698)..(4188792): a, c, t, g, unknown or other
  modified_base (4192160)..(4193162): a, c, t, g, unknown or other
  modified_base (4194106)..(4195084): a, c, t, g, unknown or other
  modified_base (4204103)..(4205139): a, c, t, g, unknown or other
  modified_base (4214844)..(4215852): a, c, t, g, unknown or other
  modified_base (4252311)..(4253359): a, c, t, g, unknown or other
  modified_base (4291725)..(4292634): a, c, t, g, unknown or other
  modified_base (4305214)..(4306258): a, c, t, g, unknown or other
  modified_base (4311637)..(4311637): a, c, t, g, unknown or other
  modified_base (4312717)..(4313689): a, c, t, g, unknown or other
  modified_base (4318946)..(4319934): a, c, t, g, unknown or other
  modified_base (4322538)..(4323489): a, c, t, g, unknown or other
  modified_base (4329249)..(4330245): a, c, t, g, unknown or other
  modified_base (4335669)..(4336641): a, c, t, g, unknown or other
  modified_base (4343793)..(4344804): a, c, t, g, unknown or other
  modified_base (4345961)..(4346979): a, c, t, g, unknown or other
  modified_base (4355771)..(4356779): a, c, t, g, unknown or other
  modified_base (4364383)..(4365185): a, c, t, g, unknown or other
  modified_base (4396745)..(4397759): a, c, t, g, unknown or other
  modified_base (4401693)..(4402682): a, c, t, g, unknown or other
  modified_base (4415944)..(4416954): a, c, t, g, unknown or other
  modified_base (4425464)..(4426331): a, c, t, g, unknown or other
  modified_base (4435980)..(4436973): a, c, t, g, unknown or other
  modified_base (4438376)..(4439324): a, c, t, g, unknown or other
  modified_base (4467801)..(4468810): a, c, t, g, unknown or other
  modified_base (4470241)..(4471231): a, c, t, g, unknown or other
  modified_base (4514442)..(4515481): a, c, t, g, unknown or other
  modified_base (4564053)..(4564974): a, c, t, g, unknown or other
  modified_base (4566413)..(4567393): a, c, t, g, unknown or other
  modified_base (4569436)..(4570455): a, c, t, g, unknown or other
  modified_base (4595936)..(4596934): a, c, t, g, unknown or other
  modified_base (4598411)..(4599397): a, c, t, g, unknown or other
  modified_base (4603665)..(4604635): a, c, t, g, unknown or other
  modified_base (4606928)..(4607950): a, c, t, g, unknown or other
  modified_base (4619209)..(4620169): a, c, t, g, unknown or other
  modified_base (4621701)..(4622691): a, c, t, g, unknown or other
  modified_base (4633050)..(4633968): a, c, t, g, unknown or other
  modified_base (4635610)..(4636591): a, c, t, g, unknown or other
  modified_base (4646982)..(4648013): a, c, t, g, unknown or other
  modified_base (4664923)..(4665916): a, c, t, g, unknown or other
  modified_base (4667654)..(4668638): a, c, t, g, unknown or other
  modified_base (4677603)..(4678498): a, c, t, g, unknown or other
  modified_base (4693843)..(4694867): a, c, t, g, unknown or other
  modified_base (4698812)..(4699799): a, c, t, g, unknown or other
  modified_base (4702275)..(4703181): a, c, t, g, unknown or other
  modified_base (4712950)..(4713869): a, c, t, g, unknown or other
  modified_base (4727043)..(4728060): a, c, t, g, unknown or other
  modified_base (4751977)..(4752968): a, c, t, g, unknown or other
  modified_base (4758397)..(4759468): a, c, t, g, unknown or other
  modified_base (4810049)..(4811037): a, c, t, g, unknown or other
  modified_base (4813593)..(4814549): a, c, t, g, unknown or other
  modified_base (4826770)..(4827751): a, c, t, g, unknown or other
  modified_base (4852232)..(4853201): a, c, t, g, unknown or other
  modified_base (4857234)..(4858276): a, c, t, g, unknown or other
  modified_base (4899764)..(4900709): a, c, t, g, unknown or other
  modified_base (4915361)..(4916403): a, c, t, g, unknown or other
  modified_base (4923123)..(4924049): a, c, t, g, unknown or other
  modified_base (4981980)..(4982982): a, c, t, g, unknown or other
  modified_base (5006768)..(5007803): a, c, t, g, unknown or other
  modified_base (5015415)..(5016420): a, c, t, g, unknown or other
  modified_base (5037740)..(5038750): a, c, t, g, unknown or other
  modified_base (5055551)..(5056521): a, c, t, g, unknown or other
  modified_base (5073303)..(5074261): a, c, t, g, unknown or other
  modified_base (5087695)..(5088664): a, c, t, g, unknown or other
  modified_base (5098455)..(5099391): a, c, t, g, unknown or other
  modified_base (5142917)..(5143940): a, c, t, g, unknown or other
  modified_base (5154721)..(5155583): a, c, t, g, unknown or other
  modified_base (5169050)..(5170065): a, c, t, g, unknown or other
  modified_base (5178737)..(5179784): a, c, t, g, unknown or other
  modified_base (5200315)..(5201257): a, c, t, g, unknown or other
  modified_base (5267717)..(5268744): a, c, t, g, unknown or other
  modified_base (5274027)..(5275119): a, c, t, g, unknown or other
  modified_base (5291752)..(5292787): a, c, t, g, unknown or other
  modified_base (5304891)..(5305929): a, c, t, g, unknown or other
  modified_base (5348717)..(5349736): a, c, t, g, unknown or other
  modified_base (5388072)..(5389057): a, c, t, g, unknown or other
  modified_base (5414978)..(5415906): a, c, t, g, unknown or other
  modified_base (5446593)..(5447513): a, c, t, g, unknown or other
  modified_base (5453569)..(5454590): a, c, t, g, unknown or other
  modified_base (5469051)..(5470113): a, c, t, g, unknown or other
  modified_base (5493387)..(5494410): a, c, t, g, unknown or other
  modified_base (5531709)..(5532692): a, c, t, g, unknown or other
  modified_base (5552166)..(5553215): a, c, t, g, unknown or other
  modified_base (5568780)..(5569796): a, c, t, g, unknown or other
  modified_base (5602139)..(5603097): a, c, t, g, unknown or other
  modified_base (5628415)..(5629399): a, c, t, g, unknown or other
  modified_base (5646327)..(5647377): a, c, t, g, unknown or other
  modified_base (5701273)..(5702304): a, c, t, g, unknown or other
  modified_base (5719941)..(5721004): a, c, t, g, unknown or other
  modified_base (5746425)..(5747350): a, c, t, g, unknown or other
  modified_base (5769057)..(5770088): a, c, t, g, unknown or other
  modified_base (5780223)..(5781300): a, c, t, g, unknown or other
  modified_base (5812156)..(5813205): a, c, t, g, unknown or other
  modified_base (5851790)..(5852836): a, c, t, g, unknown or other
  modified_base (5869385)..(5870362): a, c, t, g, unknown or other
  modified_base (5891220)..(5892227): a, c, t, g, unknown or other
  modified_base (5916216)..(5917236): a, c, t, g, unknown or other
  modified_base (5928575)..(5929592): a, c, t, g, unknown or other
  modified_base (5950724)..(5951610): a, c, t, g, unknown or other
  modified_base (5974185)..(5975118): a, c, t, g, unknown or other
  modified_base (6007564)..(6008522): a, c, t, g, unknown or other
  modified_base (6039584)..(6040583): a, c, t, g, unknown or other
  modified_base (6072330)..(6073260): a, c, t, g, unknown or other
  modified_base (6164462)..(6165495): a, c, t, g, unknown or other
  modified_base (6179215)..(6180279): a, c, t, g, unknown or other
  modified_base (6211862)..(6212870): a, c, t, g, unknown or other
  modified_base (6250362)..(6251324): a, c, t, g, unknown or other
  modified_base (6292263)..(6293251): a, c, t, g, unknown or other
  modified_base (6347156)..(6348125): a, c, t, g, unknown or other
  modified_base (6401673)..(6402745): a, c, t, g, unknown or other
  modified_base (6468949)..(6469921): a, c, t, g, unknown or other
  modified_base (6537627)..(6538765): a, c, t, g, unknown or other
cctaccagcatcgcaataggcaacgtccaattcttcaaaaacttaagcatcgtcgtatattttttcttggaggtgcaaagtaacagagatttcgggagaaaagctaccattaaaccgaaaaaaacacaaaacttaagtgtaaatcatgagttttctgcaaaattctactacatttgcaccgtatttaaatatgaaaccgcatagaacctacatattatatatatcaatctgcctctggctacttgcttctcccctatgtatcggcaatttatgggggaaagatttcgtagtagtcattgatgccggacatggcggtcacgaccccggtgccatcgggaaaatatccaaagagaaaaacatcaatctgaacgtcgcactgaaactgggaaacctgatcaaaaaaaactgcgatgacgtcaaagtgatctatacccgcagcagggatgtctttatccccctggaccgacgggcagaaatagccaataacgcaaaagccgatctctttatctctgtccacaccaacgctctggcaaaaaaccgcaccgccaaaggagcttctacatggacactgggtctggccaaatccgatgccaatctggaagtagccaaacgagagaactcggtaatcctatacgaaagcgattaccagaccagatatgccggcttcaacccgaactcggcggaatcctacattatcttcgaatttatgcaggataaatacatggaacaaagcgtacatctggcatcacttgtacagaagcaattccgccatacctgcaaacgggtagaccgcggagtgcatcaagccggattcctggtgctgaaagcaagcgccatgccaagtatcctggtagaattgggcttcatctcaactccggaagaagaacgctatctcaactcggaagccggagccaacacaatggccaaaggcatctaccacgcattcttaaactacaaaagagaacaggagatacgcctgaccggagccagcaaaacaattatcccaaccgaagaaccggcaacaagcgctccggaacaaagggaactgatggccgaagcaagtacaacacccgccaccgccacaaaaacagctcccaaacggcctattgtctcagaaagcgcaaccaatgacagcgaaataacgtttaagatacagatactcacctcctcaaagcctcttactaagaatgacaaacgactgaaaggactgaaggatgtggattattacaaagaaaaaggactgtacaaatatacgtatggcgcttccagtgattacaataaagtattacgcaccaagcgtactatctcggcacagttcaaagacgcattcatcatcgccttccgaaacggcgaaaagatgaatgtcaacgaagcgatagccgaatttaaaaaaagaagaaataaatagaaaataaaatgaagtacattacaaaagaagttcgaataggaattgcaggtatcgtagcattatgcgtgcttgtctatggaattaattggctgaaaggcatacatatgtttcagccttcaagctatttctatgccaagtttcagaatgtaaacggactgaccaagtcgagccctgtttttgctgatggcgttcgtgtaggtattgtacgcgacatcgaatatgactatgtaaatcccggaaatgtgatcgttgaagtcgaactggacaccgaactccgcatcccgaaaggaagtagcgcagaacttgtatccgaactgatgggaggcgtacgcatgaatattcttctcgccaacaacccgcgtgagaaatatgccataggcgacaccatccccggcacattgaacaacggaatgatggaaagcgtagcgaaactcatgccccaaattgagagtatgttaccgaaactggattccatcctcacctcactgaacaacatcgtaggtgacaagagcatcccttctacgctgcactctatcgaaacgactaccgccaatcttgctgtagtcagctctcagatgaaaggactcatgagcaaggacatcccccagctgaccggcaagctcaataccatcggagataattttgtagctatcagcggtaacttgaaggaagtggactacagcgccattttccaaaaagttgacgcaacactcgctaacgtaaaaatgattacagagaagttgaacagcaaagataacactatcggactgctcttcaacgaccctgctttatataacaatctgaacgctaccacagagaatgcggcgagcttactggaagacctgaaagcacaccccaaacggtacgttcatttctctttattcgggaagaaagacaagtagcaaatctttcttatatagattttatctaaataagcaggcggtatataaaagggagtataacctctgcaaaagtctatctacagaccgaaataatattcccgtacaaacaagtgcgggaagtataaaagagcaagaataaaacgataaacaactaaaatacagatacttataattttgcaagagaggggaaacagacagtgttccaacacaattctataagtcattgaaagtaaacacattattgtttgcccgagaaaaacaagaaaaagctaatttgttttttccaaataagattcccaattttgcaaacgtagaagtttcgcttaatttaataaatgtattaaagtcactatgattgaatcaaatcatgttgtactttggaaccgctgtctcgaagtaattaaagacaatgttccagagacgacatataatacttggtttgccccgattgttccattaaaatatgaggacaaaacattgatcgtacagatcccgagccagtttttctatgaaatactggaagagaaattcgtggatttgctgcgaaagacattgtacaaagctattggcgaaggcaccaagttaatgtataacgtcatggtcgacaagacttcgattccgaatcaaaccgtgaatctcgaagcaagcaatcgttctacagctgttactcctaaaagcatcgtcggtggcaacaaggcgcccagtttcctgaaagctcctgccgtacaggacttagacccgcacttgaacccgaactataacttcgagaactttatagaaggatacagcaacaaactttcaagaagcgtagcagaagcggttgcgcaaaatccagcaggtactgccttcaatccattgttcctttacggagcgtccggagtggggaaaacacacctggcaaacgcaatcggtactaaaatcaaagaattatatgccgataaaagagtattgtatgtttcggcacatctgtttcaagtgcaatatacagactccgtacgtaataacacgaccaacgactttatcaacttctaccagacaattgatgtattaatcattgatgatattcaggaatttgccggagtaacgaaaactcaaaatactttcttccatatcttcaatcatttacatcaaaacggaaagcagcttatactgacttccgaccgtgccccggtattattgcagggtatggaagaacgtctgttgacccgtttcaaatggggaatggtggcagaactggaaaaaccgactgtcgaactccgcaaaaacatcctgcggaacaagatacaccgcgacggtctgcaattcccaccggaagtgatcgactatatcgctgaaaatgtaaatgagagtgtacgagacctggaaggtatcgtcatcgccattatggcacgctctactattttcaacaaagaaatagacttggatttagcccaacatattgtacacggcgtagttcacaacgaaacaaaagcagttaccattgacgatatactgaaagtagtatgcaagcactttgatctggaagcatcggctattcacaccaaatccagaaaaagagaagtggttcaggcacgtcagattgcaatgtacctggctaagaattatacggatttctcaacttcaaaaatcggtaagttcatcggcaataaggatcatgcgacagtgctgcatgcttgcaagactgtaaaaggtcaactggaagtagataaaagctttcaggctgaggtacaggagattgagtcgttgctgaagaagaaagcataattcaagtaataggtattaagtaataggtaatatcgaagctgcataaacaagtgcagtccgcatagctattacctattacttatcattagaatccttgttgacgaagcactttcaacaagttctcagacataaattcattgtctttctttgtataacgtacatccgtaaatacttgtgccagagtttctttcttattttcttctataaactgtttattttccggcagtgattctttatactcgtacaagcgatcgatgtcttccggagtataatcatggtaaacttcctgatgcacggcagcttcgagaggcaagcggtccacctgggccggagtaccgtccggatagccgactgtgatcgtcgtaatagggaataccagtttcggcagttgaagtgtatcgatgatcatttgcggattataagtagtcgttcccagataacagatacccaagcctgcctcttcagctaacgtgcagaaggtttgcgcaaccaacaaggtatccatagacgcattcataaaagacattaaattatcgtagccgggaacagcgtttctctgttcacaccacttgctgaaacggcggaaatcggcacaaaaagtaagcacgacaggtgccccttttaccatcggctgattgaaatgagcaggagaaagtttctctttcatttctgcatcgcgagtcactataacactataaagttgcatccctcccatcgtagaagcgcggaaagaggtttcgagcaaatcatttaacaaatcaggagcaatatctttttgctggtatttccggattgttcttctgttctttacggtttcaaacatatcttttttttgcaaagatacaaaaagaaatattattttgccatatcaatgaaataatctaattttctttttggaaaacttaaagccatgaacaaaaagcaaagttatctgttaatcaaagacttaacaataacaaacggaaaacttaaagcctgttgataaaatgttgcatttttattttgatagataaaaaaacattcttagctttgcagccacatttgttactgataagtaaacttctacacattacttattaaataataaaatctaagacacattggatcgtggaaaaacaaatttattcttatgacgaagcctacgaagaatctttacgatattttcaaggcgacgagcttgctgcaagggtttgggtaaacaagtacgcagtaaaggattctttcggaaacatctatgaaaaatctccggaagatatgcattggagaattgccaatgaagtagcacgtatcgaggcaaagtatccgaatgcactgacagcaaaggaactgtatgatctgctggatcattttaagtacatcgttccgcaaggaagcccgatgacgggtatcggtaatgactatcaggtcgcttcactatccaactgcttcgtaatcggggtagacggcgcagcagactcttatggcgctatcatcaaaatcgacgaggaacaagtacagctcatgaaaaggcgtggaggagtaggtcatgacttgtctcacatccgcccgaaaggttctcccgttaaaaattcggcattgacttccactggtctcgttccgttcatggaacgttattccaactctacccgcgaagtagctcaggacggtcgtcgtggtgcactgatgctgagtgtgtctatcaagcatccggattcggaagccttcatcgacgctaaaatgacggaaggaaaagttaccggagccaatgtttccgtaaagctggacgacgctttcatgcaggcggcagttgacgagaaaccttatatacaacaatatccgattgaatcggcaaatccgactaccactaaagaaatagatgcttccacattatggaagaagattgtgcacaatgcatggaaatcggcagaacccggtgttttattttgggatacgattatccgtgaatctgtgcccgattgctacgcagatttaggttataagactgtatctaccaatccatgcggtgaaattccattgtgtccttatgactcttgtcgtctgctggctatcaatctatattcttatgtagtaaatccgtttaaaccggatgcctattttgatttcgaattgttcaaaaaacacgttgcgctggctcaacgcatcatggacgacatcatcgacctcgaactggagaagatcgaacgtatcatggaaaagatcgatcaagacccggaaggcgaagaggtaaaacatgccgaacgcaacttgtggaacaagatatataagaagagcggtcaaggtcgccgtacaggtgtgggaatcactgcggaaggcgatatgcttgctgctttaggtctgcgctacggaaccgaagaagcaaccgaattctctgaaaaagtacataagacagtggccctcggtgcctatcgttcttcggttgaaatggcaaaagaacgcggtgctttcgaaatatacagcaatgagcgtgaacagaacaatccgttcattcagcgtcttgccgaggctgatccggaactgtacgcagaaatgaagaaatatggccgtcgtaatattgcatgtctgacgattgctcctacaggaacaaccagtctgatgacacagacgacttccggtatcgaaccggtcttcctgcccgtttacaagcgcagaagaaaagtaaacccgaacgatacgaatgtacacgttgactttgttgacgagacaggcgacgcattcgaagaatatatcgtattccatcataaattcgtgacatggatggaagctaacggatacgatcccgccaagcgttattcgcaggaagagattgacgagctggtggctaagtcaccttattataaagcgacttccaatgacgtagactggttgatgaaagtaaagatgcagggaagaatccaaaaatgggtagaccactctatcagcgtaaccatcaacctgccgaacgatgtagacgaggatcttgtcaaccgcctgtatgtagaagcatggaaatccggttgcaaaggatgtacggtataccgcgacggctcacgttccggagtattgatttcaaccaaatcggataagaaagaaactcttcctccttgcaaaccgcctacggtagtagaaacacgcccaagagtactggaagccgacgtggttcgtttccagaataacaaagaaaaatgggtggctttcgtaggactgctggatggacatccttacgagatattcaccggtttgcaagatgacgacgaaggtatcctgttgccgaaaagcgtaaccagcggacgtattatcaagaatatagacgaggatggaaccaagcgttacgacttccagttcgaaaataaacgtggatacaagacgactatcgaaggattgtcagagaagttcaacaaggaatactggaactatgcaaaactgatttccggcgtactccgttaccggatgccgatcgagcaggttatcaagctggtaggttctctgcaactgaacagcgagagcatcaacacttggaagaacggtgtagaacgtgcattgaagaaatatattcaggacggaacggaagccaaaggaaagaaatgcccgaattgcggtaatgaaactttggtctatcaggaaggctgtctgatctgtaccacttgcggtgcttccagatgcggttaacatgtgacgtatgttaattaatatataaacaaaagattaaaaggagtcctaatacggctccttttattttttattcaaaaaaatgtcttatacttgcatagtcattagtgtctaatcaaaatctaatatatatgactgtatcatttaacatcgaatatcgcaccagttggggagaagaagtcaggattgccgggctgctgccggagtcgatccccatgcataccacagacggcatatactggacggcagacgtggaactggaagttcccaaagaaggaatgactatcaattacagctatcagatagaacaaaaccaaattatcatccgcaaagaatgggacagctttccgagacgtctctttttatccggtaactctaaaaagaagtatcagattaaagactgctggaaaaatatccccgaacaattgtattactacagttcggccttcacggaagccttgttagcccatcccgacagagctgaaattccgccttgtcacagaaaagggctggtcatcaaggcatacgccccacgcatcaacaaagactattgcctggcaatttgcggaaatcagaaagcattgggaaactgggacccggacaaagcgattcccatgagcgatgccaactttccggaatggcagatcgagctggatgcaagtaagctgaaattcccgctggaatacaaattcatcctttaccataaagaagaaaagaaagcggactgctgggaaaataaccccaaccgctatcttgccgacccggaactgaaaacaaatgagacgctggtcatctccgaccgatatgcctatttcgatattccggtatggaaaggggccggtatagccatccctgtcttttcactgaaatcagagaacagtttcggagtaggagatttcggagatttgaaacgcatgattgactgggctgtaagtacccaacaaaaggttatacagatattaccgatcaatgatacgaccatgactcatgcgtggaccgattcttatccatataatagtatctccatttatgctttccacccgatgtatgcagatataaagcagatgggaacactgaaagacaagtcagccgcagcgaagttcaacaaaaaacagaaagaactcaacggcctgccggcgatggattatgaagctgtcaaccaaacgaaatgggaatacttccgactgatcttcaagcaggaaggagaaaaagtattagcctccggagagttcggcgaattctttaatgccaacaaggaatggctgcaaccttacgctgttttcagctatctgcgcgatgcctttcagacacctaatttccgtgaatggcccagacattccgtttataatgcacaagatatagagaagatgtgccggccagaatctgtagattacccgcatatcgcactttattattatatccagtttcacctgcacctgcaattggtagccgctacgaaatacgcccgcgaacacggtgtcgtactcaaaggagatatccctatcggcatcagccgcaacagtgtggaagcatggaccgaaccttattacttcaatctcaacgggcaggcgggcgcccctcccgatgatttctcggtgaacggacaaaactggggattccccacgtacaactgggacgtcatggaaaaggacggctaccgctggtggatgaagcgtttccaaaaaatgtcagagtacttcgacgcttaccggattgaccacatcctcggtttcttccgtatctgggaaatcccgatgcatgccgtacacggattactcggacagttcattccctccatccctatgagtcgggaggaaatcgaaagttacggactcccctttcgggaagaatatttgattccatatattcatgaatccttcctcgggcaagtattcggtccgcataccgattatgtgaaacagacttttctgcttcctgccgaaacacccggtgtttatcacatgaaaccggagttcaccacccaacgggaagtggagagtttctttgcaggaaagaatgatgaaaacagtctttggattcgggatggactatacactttgatcagtgatgttctttttgtaccggacacgaaagaaaaagataaatatcatccgcgcatcggaatacaacgcgatttcatcttccgttcactcaatgaacaggagcagaatgcgtttaacagactgtatgatcagtattattatcaccgccacaacgagttctggcgccaacaggctatgaagaaactaccgcaactgacacaatcgacacgtatgctggtttgcggagaagacctgggtatgattccggattgtgtttcgtccgtcatgaatgatcttcgtatcctcagtctggagattcagcggatgccaaagaatccgatgcacgagttcggatatttaaatgaatacccataccggtcggtttgtaccatctccactcatgatatgtctactttgcgaggctggtgggaagaagattacctgcagacacagcgttactacaacacgatgctggggcattacggaaccgcaccgacagtcgccactcccgaattgtgcgaagaagtggtgcgcaatcatctgaaaagcaattccatactttgtattctgtccctgcaagactggctgagcattgatggcaaatggagaaatccgaatgtgcaggaagaacggattaatgtaccatccaatccgcgcaattattggcgttaccggatgcacctcactctggaacagttgatgaaagcagaagaactcaatgacaagatacgtgagctaataaaatacaccggcagagctcccaagaaataaatatctttaggcacgggtgacacggattaacacgttttttagacctataatctcttaaaactgtaaatccgtgtcatctgtgcctgaataaaatcaactgatagttttgacacctccgtttctctcccatgcggcaattctttatcttccttcattccgttttttccaattaatcaagtatctttgcaacgcaaaaacgcaacgcaaaataaatgggagacaatcagcatcggcgtattgattttgtggacttaaccaagggagtctgcattattctggtagtgatggcgcatatcggaggcgctttcgaccaacttgacaagcattccatgctatcctgctttcgcatgcctctctatttctttatatcaggaattttcttcaagccttatgaaggattatacgggttcattatccgaaagaccaataagctaatcattccctttatcttcttctacgtcagcgcctttctactaaaatacattgtatggaagattgcaccggaaactttccatctccctgtgtcatggagagaattactgtttgtctttcacgggcacgacctcatcaagttcaatcctcccatctggtttctgcttgctctgttcaactgcaatatcctgttctatctgattcattatctgcgtgacaagcatttatctctgatgtttgcagcaacgttactgatcggatgcacaggattcttcctgggcaaatttcacatcgaacttcctttgtatatagacgttgccatgactgccctccccttctatgtggcaggtttctgggttcgccgatataatttcttcctgttccccagtcatcggttcgacaagattattccctcatttgtcctgctggcactggtcgtaatgtacttcaccgccaccacgccgggtatgcggaccaacaattatcccggcaacatattccaggtatacattgccgcatttgccggaatctttatgattatgctgatctgtaagaaaataaaaagaataagcatcgtttcttatctggggcgatattccattatcacactcagtattcatggaccgattatacactttgcaagaccggtcgtttcgcattatattcataacgactgggcagaagcaagcgcactgctcctgctgacattgaccatctgcattctctttacccctatcctgcttaagataattccacagttggtggcacaaaaggatttattaaaagtcaaataacaaaacattgtgcaagccaaacttttcttaactctaagtttaattatcaaataatttactacttttgttccaaagaactatagaccgagaacaaatgaatataacgattgtcttaggagataaaattccatctataaaatacggcggaactcaaagagtaatgtggtatctgggtaaagaactcaataagcgcggacacaaagtcaccttcatcgcaggaaaaggttcctcctgccctttcgctaaagtgatagaactggaccctagcgtaaatctgaacacccaaatccccacagatgcggacatcgtacatttcaacattcccgttcccgaaggaatcaccaagccgcacttactgaccatacacggcaatggaatcccggccaacgcagaccggaacatcgtttttgtctcacgtaatcatgcacaaagacttggaagcgaatcattcgtttacaatggactggactgggatgactacggtcccgccaacctcaccctttccagaaaaaactaccattttctaggcaaagcagcctggaaggtcaaaaatatcaaaggagctatcgccgttgtccaaagcatcaagaacgcacaactggacgttttaggcggttatcgcctcaatctcaaaatgggcttccgattcacatggaatccacggattcattttcatggaatggtagatgattcaaagaaaaaagttattattgagcagtcaaaagggcttattttccccgttacatggcacgaacctttcggacttgcaatcactgaatccttatacttcggagctcccgtattcggtactccctacggtgcgcttcccgaactcgtttcaccggaagtcggttttctgaccgcccacggacaggaaatggccgaacatatacagtcagcacaatattctccgaaagtctgccacgaatatgccagagatctattcaattcaagtgtcatggcagaagcctatttaaagaaatatgaaactgtactgaacggcgaacctttgaataaagaagtcccccatattatagatatcgcacgacgtcttccatgggactaaaaatggcagttgaattacatagctgatgagtacaatctcatttataaagcctttcattcatttaataagcgaacaaaaatgatcgaaaacactttataaaaagaaataaagccttacctttacttttttagaaaacaaaagatatgaagataaacaacagctatattttgctgaaagacatctgctgctttgcttatcatggagtagccccccaagagaatatcattggaaatgagtatattatcaacttgaagttgaaggtagatatcagtcaggctattcaaacagacgacgtggtggatacggtcaactatgccgaaatacacgaagccgtgaaagctgaaatgtccatcccgtcgaagttgctggaacacgtatgcggacgaatagctaaaagactactggcagaatttcctgccattgaagaaatagaacttcgtctttccaaacggaatccgcctatgggagcagacatcgactcagccggagtagaactgcattgcagcagataagtacctttgctttatcagtttgtgttattatcaagaagcacattggtctgtcatcctatcatccggactgccacatccggtcaacttatttacaacaccctatcattccgcttgtgccaagtaatgggcacagttatgccaaaggagtatcacggttgtgacaagggtgtggcacagttgtgacaaaggcttggaaacagttgtgacaagggcatggcacagttgtgccaaaggcgtggcatcgtcgtgccaaaggcatggcacaagtaaggctgcctcatttctacttgaagcagcctcacactatcatattttcagtctataacgacctatctcttctttctttttcttttatttaccgattctacagcttccgttaccacggatttgttttcgaaccgtttcgtataactggaatagtccggatgggtacgttcgtaatcgggatccataaacagagggctggaaatgatatgatccgccgtagaacggttacaacagaaaacgatgttctcaacaccggccagtcgggttaatgctttaacatccgtatcatgtggctgcaaagtcatagggtcagtgaaaaagaatagataatcaatctgaccgtccacaatacgcgatcccatctgctggtcacctcccaaaggaccggatttcagaattgtgaagtcccactccacttcaggatgcttctccttcagtgcttccagaatcagagtacctgtagtacctgtacaatagaatttatttcccatcaacagttccgagttccacagcacccattcgatgaggtcttttttcatggcatcatgtgctaccagcccgatgcctctccttacttttggttccattttgttatccttttaaatccgacaattgagagaatcttttgcaccctcccacataaaactgccacaagatactactttttatccgttcagggattggattcaaagaagtttttcttaagttttctttacgggaagaagaaaatgaaggacaaatctgtttatattctttccgggcacgcatcaccgcacgggcgttgtctaactgccccttcagcagaaatgtgaatgcagccacgtaatcgagacaagtccggatacgcatcactttatttaactcttcgtccgaaagattcttatagagcatgacaagattattacgaaaattcaaaaaagtcttgcggggattctcctttttcagagttgcaccaccgacgtgatagaccgtactttgaggaatgcaaacgatttcccgaccacgggaacgtagtcgccagcataaatcaatctcttccatgtgggcaaagaaacgtccgtccagtccgcccgcctcacgataatccgcatgacggataaacagggcggctcccgttgcccagaaaactggcaggatcgtatcatactgtccctcatccttttcaaccactcccattatacgcccacgacagaacggatagccgtacttatctataaatcctccggctgctccggcatattcaaaatactctttttgccgctggctacggattttcggctgacaggcagctacctccggatggccatcaagataggagatcatcggttcaagccaatgttcggtcacctcaacatcagaattcagaagtaccacatactccgcttctacctgctgcaaagccaggttatatccatctgcgaatccatgattctgatccagcacaatgatccggacacaaggaaattcctcccgaagcatttccacagaagcatccgtagagccattgtcggccacacagacttctacttcttcgctcttcgaatagcggatcacggacggaagaaaagtacgaagcatatcgcacccgttccaattcaaaataaccactgacactttcatccttaccccctttcacattcagccttagaagctttccaacgtttatgagaccacagccaataagccggttccctgcgaatcgtctgttccagataatcagcaaacatttccgtaatttctccttcacccgtctccttcggtttctctgtcatcagcttaaactcagctacacaataccctctgccgggttttgtcagatcacaatagaacacagggaagttcatcattttcgcaatgcgctccgcaccattcagaaaggcggtttcctgccccaaaaaagtagtccagtatttttcgtttccgctgggccactggtcagtaatcagaccgacaaccatctttttgccttcacgcttcaacttgataatttcgcgtgccgtagaatgtttcggaacgttatatcctccgaagcgggaacggatgcgctggaacaattcgttcaagtatttatctttcagaggtttatagacttgcatcggtacatcacccggtttcataatagatcccatcccgatcagccattcataattggcataatgaggaatcattacgatgattccgccatatttctcggtcagttccagatattgttccgtattcttataagtcatccgcttataaaggtcttcgggtgacatatgaagcattttcaagtcttcaagcatatagtcggaaaggtaacgatagaaacggcgttcgatctgcagcctttctttcttgtctttttcgggaaatgatttcttcagattctcccgtactactttccggcgatacctccctatacggtacatcaacaggtaattgaaatccgaaagtaagtacaatatccggaagggaagcgccgaaaacagccacatcccgctatataccagccaatagataaatctagacttcataattcatcagaattgtgcctttaagcgctgtcatgtcttcattaaattctcccagtcggacgttaatcatctgattgtccaatgattcgtcattctccacttctacgcggatatagttagcggtaaacccgtgcatcggtgtacctgcttttgatttttccatcaatacctgcatggtctgcccgatatgacgggtatagaaagcccgtgtcttttcatcagaaagtgtcagcaagcgctggctgcgctgatgtttctcttccggcgaaaccacataatctatcttcaaggcctgcgtccccggacgttcggagtagctgaacacatgcaactgtgtcacatccagtccggaaataaactgataagcctgttcaaaatactcttccgtctctccgcgagtacctacaatcacatcgactccgataaaggcatccggcatcacttccttgattttctttactttagaggcaaaaagagccgtatcataacgacggcgcatcaatttcagcacttcatcgcaaccggattgcaacgggatatgaaaatgaggcataaatctacgggaacgggaaacgaactcgatgatttcatcagtcagcagattgggctcgatagaagaaatgcggtaacgttcgatgccttccacctgatccagcgctttcaccagatcaaagaaagtctcaccggtagtcttaccaaaatcgccgatattcacgcctgtcagtacgatctcttttccgccttcggcagcggcctgccttgcctgctccaccatagaggcaacagtaccgttacggctgcgtccacgggcaaaaggaatggtacaataagaacagaaataatcgcatccgtcttgtactttcaggaagaaacgagtacggtcgccccgtgaacacgaaggcgaaaacgaacggatatctttggtggtggtagtaaatgcctctccctcttcatgcttatggaggtcgccgagatactgcaacaagtctcctttctgctcggcacccagcactacatctactccttttatctttgccacgtcaccgggcttcaactgtgcgtagcatccggtcactaccacaaaagctccgggatgctgcttgaccaaccgatgaatagcctgacggcatttcttgtctgccatctccgtcaccgaacaagtatttaccacacagatatctgctttttcccctttgcgtgcagtccggactcctgcctcccgcaggattttaccgatagttgaagtctctgaaaagttcaatttgcagcctaacgtataataaacggctgtcttattttgaaatacagtggtatctatcataatctgttataacgcatatttcctgcaaagttacacattattattagtaaaacactttaggatacgaaagtttattcctatttttgcacaattcactaaaaaacgtgcaatgattaaagagaatttcattaaactatacgaaaatagttttcgggaaaattgggatttaccttgctataccgattatggtgaatccgttcattatacttatggccaggtagccggagaaatcgcccgtatgcacctgcttttcaaacattgcagcctgcgcagaggagataaaatagccgttatcggcaaaaataatgcccactggtgcatcgcctacatggcaaccatcacctacggagccatcatcgtccctatcctgcaagactttacgcccaacgatgtgcatcatatcgtcaaccattccgagtccgttttcctctttaccagtgacagcatctgggaaagcctggaagaagaaaagctgaccggactgcgcggagttttttcgctcaccgacttccgctgcctctatcagcgggacggagaaactattcagaagtttctggtacacctcaatgatgaaatgtacgccgcctatccgaaaggattcacgcgcgaggacattcaatacactacgttatccaatgataaggtaatgctgctgaactacacatcgggaactaccggcttcagcaaaggggtaatgctgacgggcaacaatcttgccggcaatgtcactttcggcatccgcaccgagttacttaaaaaaggagataaagtgctttctttcctgccactggcacacgcctacggttgcgctttcgactttctgactgcaactgctgtcggaactcatgtcaccctgctcggtaaaacgccttctcccaaaattatcatgaaggcttttgaggaagtaaaaccgaacctgatcatcactgttccgctggtcatcgagaaaatatataaaaatgtcattcagccgctcattaataagaaaggtatgaaatgggcattaaacattcctttgctcgacacccagatttataatcagatacggaaaaagctgatagacgccttaggcggacgtttcaaagaaatcatcatcggaggcgctgccatgaatcaggaagtggaagagttcttctacaaaataaagttccctttcaccatcggttatggtatgaccgagtgcggaccactgatcagctatgctccctggaatgaatttattttaggctcttccggcaaagtgctggatatcatggaggcacgcatctataaagaaaatccggaagcggaaaccggagagattcaggtacgtggtgaaaacgtgatggtgggatattataagaatccggaagccacgcaggaagtgtttaccgaagacggctggctgcgcaccggcgaccttggtactatggacgccagcggaaatatcttcatccgcggacgactcaaaagcatgattctgagttcgagcggacagaacatcttccccgaagagctggaagccaaactcaataacctgccattcattcttgaaagcctcgtcatcgaacgcaacaagaaactggtggcactggtctatgcggattacgaagcgctggattctctcggattgaacaatccggataacctgaaaaccatcatggatgaaaatctgaagaacttaaataataatgtagctgcgtatgaaaaagtcagcaagattcagctttatcctacggaatttgagaaaaccccgaaaagaagcatcaaaaggtatctatataacagtatagctgtcgattagtatgttttaaaacatggattgaaggcgtaatataacaagcttctaaaaaaaattataaaaatagttggcttttcgagaacaacatattgaaaaagtacataactttgcagcgttttaataaagcaattgattgtattacgtttttaaaaagcaaagaaaatgaaaaaattagttttgatggccgtagctatcgtagcagtatcattcgcatcttgtggtaacaaagcagctgacgcagcaaaagctcaacaagattctatccgcatcgctgactcaatcgcagctgtagaagcagcagcagctgaagcagaacaagcagcagctcaggcagctgactctttgaatgcagatagcactgcaactgaagctgtagctgaataattcagaacagcctagagagaattgaaagtctgacatgctaaaagcatgcacagacttttttttatgccttatttagcgtatgagcttttaacaaaaggagcatccagcaaataatccagacttacctcgacacttttctctacgggcatgctgtagctttctatctctgcaacaagatgcttcacaccagccgtctttgcattcttgaaaatagcgtcgaaaccaaccattccgctctgcccgatttctctgtgatccttgatatggaacattttaaaacgaccggggtatttattaaaataatctaccggactgttttgcccgcgaactacccaataaacatccatctggaagaaaacatattcaggattggtatgctcaatcatgtagtcatacatcactttatcttctaccttctgaaattcatgagcatgattatggtatccgaacgacatcccctgctgtttacaacgtttgcctatttcattgtaataagcacaatatgtatccaactccttaagtgttttaggcacatccatccaaggagctacaatgtaactcataccggcagctttatgatcagcaatacactggtcccaccattgaagtgaacttgaaaaatcaccggaagctaattcttctttcgacaatcctcttgtgcaatgtgaggataaaaccttcagcccggcagattcaacatcttttttaaattgatcgggagttctgtcgtaaaactttccattattataattggcggcttccacactggtatatcccattttcgccaagttcttcagaagagtaatataagcggcgtcacatttgccgtccttattgtccaccttattcaatatatccctgacagaatagagttgaatcgctacttcttttttagctttcgcttttgttttagactgtgccatggccgtaaacggaatcattaaaagaagagccagcgcacatagatttatttggagtttcatgtttgtagataaaggggttcatgtattaaaataaaaaagctgtgtcagaagttcgtcgggcatatcattctgtcattcagaactaaatgccatgttgatgttacttttgacacagcctatctttgaattatttatgtgatcagtccagaactttcacgcggatattgcggaaccaaacgtcatcaccgtgatcctgcattccgataaatccttcgtggttttcgccaccgcaattattcagcagttcgaaagccaacggccatttgtcctggctgaatttgctggcttgcaaaaggtcagtccattgtttggtccacaagtggtattcgagtacattctcgtcattctgtccgtgaacaacagtacctttataaaccatgatcttagccttgttccattcgccgaaaggtttcgcattctgaggaactgccggaatcatgtcatataaagaagccgactgccggttattgtctttccccaatttagcatccggatgattgtcgttgtccaatacctgatattcaggtgcggaaatataaataggttcgagcacgtcgttgccgtccttatctttagaagtcacttcctgagctaaatagaagataccggagttaccgcctttggaaactttccattccatttccagttcgaagtttttgaatttgtgagcaaagatcaggtctccgccatcaccatcctgtgcttcaccgccaccggaaccgttgaacttgatgcaaccgtcctcgatagtccacttggaaggaactctgtccttgccataaccacgccatccattaaatgttttgccgtcaaagatagtgatgtaaccatccgcatctaccggtaattgcaagctatccatctccgctgcttttaatgattttgaatatgatactgctacttcgtttgccgattgctcttcctgagcactcccggctttcttctgaccgctgcaggaaactaaaactcccgctgcaagacaacaagctaatggataaaatactttcttcataataataactatttaatttttaatctttaattcttaacttacttttatcgtgttatcgtggcatatcaggcaacttccatccttcacgataattatgtttcaccagttcggctgcaaattgtttcgcgttgatcggatctgtccaggtcttattgaatgacgggtgaccatcatgaatcgtaaatccgtccttaatgcaggttctgagtgtttcgttatcaccaatattagtgaagcacatattagcgccgtcccattccagtgtcttgttcaatccttgcagacggatagccaatacacccattaccaccatttcattcatcggtcccgattcggagaaatccgctttcggcatcacgcggttggatttgtcttccttacaagcgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagtcagaccaccaccggggcccatcagttgttttccttccgggaaacctttcggacgttccggcatcataccgccgtcataccagtgtacctcaacttccggcaaggcaactttcggcatattgtcgcgggcggggaaaatcatcttcacgtgttgggcctgaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttcagagctctgaacggctggtgcagaatatgacaggccatatcacccagtgcacctgtaccgtaatcccaccatccacgccagttccagggatgataaacgttgttgtacgggttcagtttggcaggtccggtgaaaagatcccagttcaatgtgttggggatgcggtccgccttttcgggtgcattcagtccttgcggccagataggacggtcggtggcgcattccactttggttacttcgccgatttctccattccatatccattcgcaaaccaggtcggtaccttcgcccgatgctccctgattacccatttgagtaactactccggtagaggcggccagcttggtcagcaaacgggattcgtaaacggagtgagtcaacggtttctggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtctgccgtgatgatggcatgagtatggtcggcggtagcaatgattacgccgtcaatggatttgcccatttcatcgtacatcttgcgataatcccagtatttcttcgcattcgggaattcatcgaatacgcctttggcatatttccagtctacgtcacaaagggctacgatgttttcggtgcccttcacgttgttgatgttggcatgacccataccgccgatacctacggctgcaaggttcagtttgtcggttggggaaacgtgcccgtggctcatacctaaaatagagctgggagcaatggtgattcctgctaaagcagcggctcccgttttaagaaattttcttcttgaaaagtctgacatggttttattattttaaggagttagttatttgtggtggattactatgcagcaacccatatccatttttcatgttttttctgcgttcgcgtatttgttcaagagtctgcaaattaccgatagccggcaagtcattcatacgagcatcctgcaggaatttccacgcatactcggatgcaatagtcgagtcatacattaaaggcaaacgagggtttcgcttaccggtcaatatggaatcggcgaacaaatcgcacagcacatcaatattcttaccaccaaaaggtttttccacacgaagtgtctgatgtactccgtgtaaatcgacaacagctgttttgaaatcatgcgtcatacgcacgataccttccgtacctataatatctacataagaattgtgcgtctgatctttcgataattgtccatagacaaaaccctgggttatatcaaagactacgccattttgaaaagttccgtgacattgtacccaccagggatctttataattccacatgttcacgccttgtgcattccatgttctatattcactttcggcataccagcgaacgatgtcaacataatgcattccacaatcatggaaagcggggccttcatattcatgtccttcacccggtgccagtcccggagtcatgtggcaaatacggataatggctaactcacctatttctcccttctggatatattccttcatcagattatgataccaggaatttcgcagatataagtttaccgtagaaagtacattggagttttctatcatatccaccaccttccactccttttccatcgtatctgcaacaggtttttccgcgatgatatgttttccgtaccgaatagccttttctatttgttcgagccttgagtctgccaatgtgaagagcccgacaacctgtacactctcgtcttcaaagattttttgatcattctctactacaagagattcaggagatatttttttagcaagttcgcgcgtggtaggatctgtatcgcaaatataggcaatctcccatcgcccgcttttccgcatcgcctcccaatagaatcttcccattctaccgaaaccgattattcctacttttatttttgtgtcaagtgaaaattgtgcatccataaaaaattgcgaatttaagtacaaacaacataaaaggtatcaattttcatctgtaggcagattgttcgaaaactgatatcgcaaaactagccaaataaataacgctttatttagtctacacaactttatgtagattataaaatcatattacatattataaatcaacactttagatatacacaaggatataaaaaatgtagattgtttggaaagtattttatttatcgaatggcacaaattcgtttatattggtcagattttcataatttcattttcaaattcatcccgatctactgcagccttgttacgcattttagtacgataattataaacagtacttgtagagcaacgaaggaaattggcaatctttccgctatccgtaatgcccaaacgtaacagcgcatagatacgaagttccctattcaacaaagcgtcctgtttaagaatgatcttctcgtcatctttcagtaaagcattgaaatctgaaacaaaagtcggatataaattcagaaagactctatcgaagcgagtatacagagcatcaagttcatcatcaatcaatgcggaagatttcagctttttaatcagttcctcatagcacttattaatggctattttatacagcatattctgatacttctccattttatgaatatagctgaagcacacgtcgaaaaactgagcgatataatgctcctttatattattaatctcgcacagttcatcattcttatcattcaactcactattcatgctgttcagtttgtcgttcagtctcaaaagttcctcgttactttgtgccagcgcccgtttcatccgcaacgtttttttcatctgaatataaataaatacgaccaacacgattaaaagaaaaagagaaacgctggttgagataagaaaagtaatcagattcgatttagacctagcttcttccgtctgataagccgtattaataatagaatagaatttatagatttccattgcccggaaatgaatgccggaggaaacgacatcatcaatagccgactgagtaaatttgaaagcatccgctaaattattttcctcatattgtatcagtgcaagtgcctgcagggaggctgtttcgcgtgtggcattctgaatatcagcaatggcggacatcataagatatttcttcgcatcatcctctcttttcaaatagcggctcagcatggcatacgaatgagtaatcatcgcatagttaggagtgcctacctcctcagcattcagcaactcatccaaaatcttgatcgcctttgttgaatcgtgtcctgcataagaataagcccgtgacaatttatagtcaaaggaagtatgatccataagagcatacagtgaatcctgataggcttcccgtttttttccgtactgattattggtagcagaaatcgaataatactcccaaaaacgggcatatgtatcataataagtagctaataatgaacgaggaaattctgatggcttcattttttcgagaagtaattctgcatctctatatctgccgcacatggaatatacaaggctgagttgcaaagaagactggtatttcaaatagtttctatttaactgacgagcgatttcaaggttccggtcgacataatggatggcagagtctatattaaatttcttatactcattgtataattggagattcaccttatattcccgatcgggagtcaacccagagtccttcagtaaacatttaatccgagcgattcgctgctctttcttctggacgaagagcggcttcgcatctatcattttatgcagagagtcagccagtattttcaattcgttatttgcataaagagcattgccaattcccagagcaaccaggaacagcaaaacgattctcttcagataacaacggttgaatttcatattattagcaaagatgataaaaaaaagcgatttatccatcagaacaaatcgcttttttaatatatgaagtaaatttgttcttattcagcaactacttcgaaaggaatttctacagaaacttccttgtgaagtttaacgatagctttgtagttaccaacttctttcacagcgtcttttacaacgatgatctttctgtcaatttcgtgacccagttttgccaatgcttcagcaatctggatattgctaacagaaccgaagatagtacctgttgaactaacttttgttgcaatagtcaaagaaacgccttccaacttagcagccaatgcttcagcatccttcttgattttctcaagtttgtgagcacgttgtttcaagtcttcagccaacattttctttgcagaaggagaagcgatgatagcttttccagtcgggatcagataattacgaccgtatccggatttcacgtttacgatatcgttcttataacccaagtttacgatgtcttctttcaatataatttccatacttttcctccttcttatttcatcatgtcagttacataaggcaacaatgccaagtgacgagctctcttcacagcctgtgcgatacgacgttggaacttcaaagaagtaccagtgatacgacgtggaagaatctttccttgttcgttcaagaatttcttcaagaattcaggatctttgtagtcgatataacggataccgctctttttgaaacgacagtattttttcttcttaacgtctactgagggcggagttaaatatctgatttctgattgagtctgttgtgccatgattaatcctcctttttgtttgatttaacacttcttcttttagcagcatattccgcagcatacttgtccattttgaaagtcaagaagcggataacgcgttcatcacgacggaagttaagttccaacttgtcaatgacagtaggatctgcattgaactcaaccaattgataaaaacctgttgacttcttctgaattggataagccaatttcttcagtccccagttttcttcattgataatctcagcaccttcagcttgaagaatacctttgaatttttctaccgcttccttcatctgaacatcagacaaaacgggagttaaaatgaaaacggtttcgtattgattcatactcgtttaattaaataaataatttattttattttaaaatgcgggtgcaaagttaggcattttattttgaactacaaatatttaatctttttttgtatcctaatgtaggaattatccgtataaggtatgatagtatatatcagcatgatagtgtatatctaacggtaaaaggagatacggtatatcagtataaatataaatatctgtataagtaccaatatgtaaataagacagatactttgataaagactgattcaatacaagttccttatccagtagagaaacaacttgctaaatggcagcagtttaaactggacttagggggaattgctatgctgattattatagtaatcgtttttattttactaggaaggactgtgcatagattgaaaatatgaagggatagtgtcgaatatatggtagtaaagttgatgcgcgtgaactcggctatttctcttaatgtggatatagccgagtatgtgcagattgtatatcatctgcgtattggttatatatcctataaataaatgaatttattttcttctctcgcctttattatcaactattttgtacctttgcctgtatagagcaaaaaatattgagattatggcaaaaataacgattccttatgcagtatccgattttgtagagatgcgagagcgtggcttttattatgttgataagacaaggtacatttcaggtcttgaggattataaagctcctgtattcctacgtcctcgccgttttgggaagagcttgctgatttctatgctagcctgttattacgatcgtactaaagcacatcgtttcgaagaactgtttggaaacacttggattggtagtcatcccacatcagaacacaaccgttatatgattatccgctatgatttttcggctatggtaatggcggacaatatacaaggtttgacacagaattttaatgatttgaactgtggtcctgtagaagtcatggtagaacataaccgtgatttgttcggggattttcagtttgtcaatcggggggatgccgcaaaaatgctcgaagaggctcttacttatattcgttctcatgaattgccaaaagtctatattctgattgatgaatatgacaacttcaccaatcaactccttacagcttacaatgatccgctctatgaggaagttactactgccgatagctttctccgcactttttttaaagtaataaagaaaggtattggtgaagggagcattcgcacttgtttttgcacaggtgtgctacctgttactatggacgatctgaccagtggatataatattgccgaaatactcacgctggaaccgaacttcctgaatatgctcggctttacgtatgaagaaacagaaacttatttgcgctatgtgcttgataaatatgctgctggacaagatcgttatgatgaaatctggcaactcatagtgagtaactacgatggttaccgtttccgtcctaatggggaacgcctttttaattctaccatccttacttattttttcaaaaagttcgctgctaatgccggtagcattccggatgagctggttgacgagaatttacgtacagacattaactggatacgtcgtcttactttatcgttggataatgctaaaaagatgctggacgcattagttattgacgatgaattaccatacaatgtagctgatctttccagtaaattcaataagagaaagttctttaataaggaattttatccggtgagcttgttctatttggggatgacaacgcttaaagataactatgtgacgacattgcctaatatgacgatgcgcagcgtctatatggattattataatcagttaaatcaaatagagggaaatgcacagcgttatgttcctgtataccggaaatatgatgctgaccgtcgtttggaaccattggtgcagaattattttgaacaatatttaggacaattcctggcacaggtattcgacaaaataaatgagaattttattcgttgttctttttatgaacttgtttcccgttatttgagcagctgttatacgtttgctatcgaacagaacaactctgccggacgttcggattttgaaatggcaggaattcccggtacggattactatacggatgatagagtagtggagttcaagtactatcggggtaaggatgctgagagaatgttatctcttagtgaaccgcttcctgagcacgtggagcaggtaaaaggctatgctgaggatacaaaaaggaaatttcctaattacaatgtgcgaacttatgtggtgtatatctgctctaacaaagggtggaaatgttgggaggtatattaaaataaaataagaaaaaacagtagactcaagcaataaagcgtgaacctactgtttcctttttctgtatttacttctatttactataagacgcctttacaaaaggagcatccagcaaatagtccagactcttcttgacactttcctctacaggacaactgtacccttctatttcagcaacaatatgctttacgccggcaacctttgcatttctgaagatagcatcgaatccgaccataccactatctccgatttctttgtcatctttgatatgaagcacggtgaaacgtcccggatacttgttgaaatagtccacaggactgtgctgccctctgacaatccaatatacatccatctgaaaaaagacatactcaggattggtattctcaatcatatagtccaacataaccgcttgattttctactttctgaaattcatgcgcatgattatgatatccgaatttcataccgttctgctggcatcttttgcctatttcattgaaatagtcgcaatacatcttcatctctttcattgttttaggaacaccgattcccggatttacgatgtatttcatgcctgctgctttatgagcggcaatgctttgatcccaccatttcagtgactcggagaaatctccggaagccacttccttgtccgacaatcctctggaacaatgtgaagacagtactttcataccagccttttcgacagcattcttaaactcttccggagttttgccatagaacttgccattatcataattggcggcttcgatgctggtgtatcccatttgcgccagattcttcaacactacgttgaggtcggttccattatttatgatgtctctgaccgaatagagttgtatggcaatgtctttcttctttttcgcatctgctgcctgcggaattgccagcagcaatgcgaacagcactaataaatagttcgttttcataatatgatgcattagtcaagaaccttcacgcggatattgcggaaccatacgtcatcaccgtgatcctgcattccgataaatccttcgtggttttcaccaccgcaattattcagcagttcgaaagccaacggccatttgtcctgactgaacttgctggcctgcaaaaggtcggtccattgtttggtccacaagtgatattcgagtacattctcgtcattctgtccgtgaacaaccgtacctttataaaccatgatcttagccttgttccattcaccgaaaggttttgcattctgaggaactgccggaatcatgtcatataaagaagccgactgacggttattgtctttccccaatttagcatccggatgattgtcattgtccaatacctgatattcaggtgcggaaatatagatcggttcgagcacgtcgttaccgtccttatctttagaagtcacttcctgagctaaatagaagataccggagttaccgcctttggaaactttccattccatttccagttcgaagtttttgaatttgtgggcaaagatcaggtctccgccgtcaccgttctgcgcttcaccgctaccagaaccgttgaacttgatacaaccgtcctcgatagtccacttggaaggaactctgtccttgccataaccacgccatccattaaatgttttgccgtcaaagatagtgatgtaaccatccgcatctactggtaattgcaagctatccatctctgccgcttttaatgattttgaatatgataatgctacttcgtttgccgattgctcttcctgagcactcccggctttcttctgaccgctgcaggaaactaaaactcccgctgcgagacaacaagctaatgggtaaaatacttttttcatataatatcaatttatttttttgatctttaatttcctcttatcgtggcatatcaggcaaattccatccttcgcgataattatgtttcaccaattcggctgcgaattgtttcgcattgatcggatctgtccaggtcttattgaatgacgggtgaccatcatgaattgtaaatccgtccttaatgcaggttctgagtgtttcgttatcaccgatattagtgaagcacatattagcgccgtcccattccaatgtcttgttcaatccttgcagacggatagccaatacacccattaccaccatttcattcatcggtcccgattcggagaaatccgctttcggcatcacgcggttggatttgtcttccttacaagcgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagtcagaccaccaccggggcccatcagttgttttccttctgggaaacctttcggacgttccggcatcataccgccgtcataccagtgtacctcaacttccggcaaggcaactttcggcatattgtcgcgggcggggaaaatcatcttcacgtgttgggcctgaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcttcagagctctgaacggctgatgcagaatatgacaggccatatctcccagtgcacctgtaccgtaatcccaccatccgcgccagttccagggatgataaacgttgttgtacgggttcagtttggcaggtccggtgaaaagatcccagtttaatgtgttggggatgcggtccgccttttcgggtgcattcagtccttgcggccagataggacggtcggtggcgcattccactttggttacttcgccgatttctccattccagatccattcgcaaaccaggtcggtaccttcgcccgatgctccctggttacccatttgagtaactactccagtagaggcggcaaggttggtcagcaaacgggattcgtaaacggagtgagtcaacggtttctggcaatatacgtgtttgcccattgtcatagcgtctgccgtgatgatggcatgagtatggtcggcggtagcaatgattacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggaattcatcgaatacgcctttggcatatttccagtctacgtcacaaagggctacgatgttttcggtgcccttcacgttgttgatgttggcatgtcccataccgccgatacctacggctgcgaggttcagtttgtcggttggggaaacgtgtccgtggctcatacctaagatagagctgggagcaatggtgattcctgctaaagcagcagcccccgttttaagaaattttcttcttgaaaagtctgacatggttttatttttaagagttaataattgatttcagtttcttattttattgaatatttattatggcttttgaagtaatccgtatccatttttcatatttcttcttctttcccatatttgctcaagtgtctccagttcaccgatagcaggcaaatcatgtgtataggcatcgtgcaaaaaggtccatgcatattccgatgcgatggctgaatcgcgtatgagcggcagttggggatttctgattccggtctctatggagtcggcgaataagtcgcacagcacatcgatgttttttccaccgaacggcttctctatatgatgggtctgcgtcactccacgcagatcgacgacagctgttttgaaatcatgcgtcattcgggcgatacctttggtaccgatgatgtccacgtatgagttatgagtctgatctttggacaattgtccgtacacaaacccctgagtgatatcaaaaacaacgccgttctggaatgtcccgtgacactgtacccaccaaggatctttataactccacatattgacgccctgcgcatgccatgtcttgtattcgcatccggcataccagcgtgcaatgtctacataatgcattccgcagtcatggaaggcgggaccttcatattcgtgaccttcgcctggtgcgaggcccggagtcatgtggcagattcgcagaatggcaagttcgccgatctcgccctgatcaataaactgtttgatagtctgatgataccaggcgttgcggagatacaaattgacggtagaaaaacaactggctttctcggtgatgtctactactttccattctttgtctatggtgtctgataccggtttctcggagatgatatgtttcccgtatttgatagccttttcaatccggtcaagccttgagtctgccaatgcgaagagtccgaccacctgcacactttcatcatcgaacatttcctgttcattttcgagtattttcgattcgggcgacaattgctttgccagttcgcggcagtcgggattgatgtcgcaaatgtatgcgacatcccatcttccgcttttctgcatctctttcaaataaaatcgtcccattcgaccgaatccaataagaccaactttaattttcatcgtatatcttttttagtttctttatcccattatatactttgccttgtgaggcatcagcttatatagtaacgcggtgaatgcccagctgcaaaggaaaatacaaactgccatcaacggaacctgcaacggaattggaatttccgaaggacctatcagcagaaagaacggacctactacaaagtagtgtaccatataaattccgaaaccacattgggtcatgttggctaatgctttgacgatgacaggtgtattgatcactactttctgcaacatcaggaacatggccaaagtcatcagtaacacgttcggactacagaatgtgaagtaaagttccatctcagtctccgtagcattcgggttggcggcagttgtgctgaaccctgtgtacgtcacataatatccaatggcaaacatcacggcacaaatgaggaatgtcttccaaacactccaatcattagtaagacgatcatcttttgacgaaccactaaaaggccagaaaatttttagtgcatttccgttgccgccttctttcagataatgtcccaacagcaggtagccgttgaatccggcaaagtagtagaacatactgaactcgttccacgtgtcagtgccgaatacatagccgctccggtcgaaaagcatattggctacatattcgcggatatacgggataaacagggaaacaatccagatgaaaaggaaaatttgtttggttttattgcttgcccgctctacccatgcagagaagaaaggcatataaagatacaatccgatgagcagatagatataccacatatggttctccttatggctgaagttgaacggtatcatggctacatctttcagagaatcgatgaggctttgcgactcatgtccctgagtatagcagaagaagtcgccgatgatttctttgggcagacccagcagccccgtgaaccaggggaacatactgtaaagtaccgaccagatgaggaacgggaaaagtacgcggaagatgcgcttcttataaaaagtgcctaaaggctgttgcttgaccggtagcagcagtaatccggtcatcattacgaataagggaaccgaaggacggagaagcgaaccgtagatggctgcccaatgtgtgtactcgggaataacgcgcatcgtaggagaaatgtaaaaagggtcaatgcaatgtacgccgattaccattagcatggcgacgcaacggacaacatccagccagaccatccggttgtccgcaatagagttttgagtcatgatattttgtttttaagttatgtaggcaaagttagcgaacgccgaaagcaaccatcattaaaaactgatcattttagaacaatctctgaccatttcgagtataaatgcttatttttgcatctgataatgtctatttatacagaaaacttatgctgaaaatattagtaacgtatgccgttcaaggcgaatttgtagagataaagtggcccgatgtagagccttattacatccgtacggggatcggaaaagtgaagtccgcctttcatctggcagaagcgatccgccaggtgcagcccgatctcgttttgaatctcggaagtgcaggaacagtcaatcatcaggtaggggatatctttgtctgccgcaaatttatagaccgcgatatgcagaaacttgccggactaggtatggaatgcgaaatagattcttccgctttgctcgaaacaaaaggcttctgcaagcattggacggaagagggaatctgtaatacgggagatggtttcctgacggaactgactcacgtaagcggagatgtcgtcgacatggaagcgtatgcgcaagccttcgtctgccgttccaaagagattccttttatctccgtgaagtacgtgaccgacattatcggacaaaactccgtgaaacattgggaggacaaacttgccgacgcccgtcaggggctttcgaactatttcaatgtcttgaaagaaagaatatgataggtgactcctgccgctatcagtcccagaagaattttcacccataggaacggaatcaggaagaagatgcaatagagcatcgttccccacatcagcacaagggagataatcttggcgcggagcggtattgccttgttttcccggaaattgcggatgtatggaccgaagtgccggtgattcagcaaccagttatataatcgtggcgaccctttgaaataaagtgcggcggtcagtaacagaaaaggggtagtgggcagtaacggcagaaagatgccgagaatgccgagtccgagagatatgcttcctaaaacaatataaagagttttcattcggcaaagatagtgtaaaaacaggaaaaaataatcgggtttgctggatgaaagctctttttatattacctttgtccttgcatcgaggtgacattagatgcttgtaactatattaaatatatacagccatgtttacagtaatcaaacgcatggagatatcagcttctcacaagctggtacttccgtatcgcagtaaatgcgccagtctacacggtcacaactggattatcactgtctattgccgttcctcacggctcaactccgaaggaatggtggtggatttcacccgaatcaaagaagtggtcacggagaaactggaccatcagaatctgaatgaagtacttccattcaatccgacagcagaaaacattgcccgatgggtttgcaggcagattccgcaatgctataaagtagaagtgcaggagtccgaaggaaacatcgtcatctacgagaaagatgctgtggcaaacgagaaaactccggcagcaggagagacagaatagacaatagaaattttagaacagctcgaatgatgagaaagattaatgaaatcttttacagtctacagggtgaaggctaccacacaggtactccggcagtcttcatccgtttttccggatgcaacctgaaatgcagtttttgcgacacacaacacgaagcaggcaccttgatgactgacgacgaaatcatagccgaagtcagcaaatatcccgccgttaccgttatcctcacagggggagaaccttcgctctggatagacgacgcactgatcgaccgtctgcacgaagcgggtaaatacgtttgtatcgaaaccaacggcacgcgaccgctgccggagtccatcgactgggtgacctgttcgcccaagcagggtgtcaaattagggattacccggatggatgaagtgaaagttgtctacgaagggcaagatataagtatttatgaactgcttcccgctgaacattttttcctccagccttgttcttgtaataacactgctttgacagtggactgtgtaatgcgacatcctaaatggagactaagcctgcaaacacacaaactaatcgacatccggtaagcagagaaaacggatgtagtagcagaggatgcatctaaattttacgtaatataattatgaaagtaggtttatttattccttgttatatcaatgctatctatcccaatgtgggggtagcatcgtataaactattgaaaagtttaggagtagatgtcgattatccgttggatcagacctgttgcggacaaccgatggcgaatgccggttttgaagatgaatcgatgaagctggcgctccgttttgacgatctgttccgggagtacgattacattgtcggcccttccgccagttgtgtggcatttgtgaaagagaatcatcccggtatccttgaaaaagaagggcacgtctgccagagtgcggggaagatttacgacctttgcgagtttatccatgatgtgcttaaaccgacgaagatacccgcacgcttcccgcataaagtcagtatccacaacagttgccacggtgtgcgtgaactcttaatttccgctcccagtgagttaaatatcccttattacaataaattgcgcgatctgctcgatatggtcgaaggcatcgaagttttcgagcccagccatatagacgaatgttgcgggtttggtggtatgtttgccgtagaagagcaggcggtgtccgtctgcatggggcgtgataaggtgaaagaccacatggctaccggagccgaatacattgtcggagcggacagttcctgcctgatgcacatgcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcataacgaaaccctttggatggtccgagccaaaagggacaagatgagcaaggaagttcccgaatgggaagagcttcgcaacaaggcctgtgaactgaaactttattccaacagccacctcgaagagctcttgcaagagtttgaaaagaacgccactgccaacggagcgattgtgcactgggcaaaagatgcggacgaatattgtgccattgtgtacgaaatactgaatgagcataatgtacatcatttcatcaagagcaagtcgatgcttgccgaagagtgcgggttgaatcccttcttgatggaacgcggaatagacgtggtagagtccgacttgggcgaacgtattctgcaattgatgcatctcgagccgagccatatcgttcttcctgctatccacatcaaacgggagcaagtgggagaactgtttgaaaaggaaatggggacggaaaaaggaaacttcgacccgacctaccttactcatgccgcacgcaagaatctgcgccacctctttctgaatgcggaagccgccatgacgggcgccaactttgccgtagcctctaccggagacattgtagtctgcaccaatgaagggaatgccgatatgggtacttcttatccgaagttgaatatagccgctttcggcatggagaagatcgtgccggatctggatgcgctaggtgtgttcacccgtctgctggcacgttcggcaaccggacagccggtgactacctatacctctcattaccgccgtccgcgtgaaggtggcgaatatcatattattattgtggataacggccggagtacgatcctttccaagcccgaccatatcaagacattaaactgtatccgttgcggtgcctgtatgaatacctgtccggtctatcgccggagtgggggatactcctacacttactttatacccggccctatcggtatcaatctggggatggctcatgatccggagaagtattatgataatctttccgcctgctccttgtgtatgtcctgttctgatgtctgtccggtaaaagtggatttggcagaacagatttacaagtggcgtcaagaccttgacggattgggaaaggcgaataccggaaagaagataatgtccggtggcatgaagttcctgatggagcgtcctgcattgttcaatgcggctctgtgggcggctccgatggtaaacggcctgccacgctttatgaagtacaatgactttgacgattggggcaaaggacgcgaactgccggaatttgccaaagagtcattcaacgaaatgtggaagaaaaacgaggtacagggaaaggaggaatcaaaatgagcagcagagaagaaatattggcgagcatccgtaagcatacgcagacacgctacgaaaaaccggatatagcagatatgaaacgtttgacgtatccggacaaaatagagcaattttgcgctatcagccgtgcggtaggcggtacggtagtggtattgggtgaaggcgaagatgtgaatgctgtcattcgccggacgtatccggatgcgatgcgcattgcttccgtattgccggatatatcttgcgcaactttcaatccggatatggtggacgacccgaaagaactggacggtactgaggtagccgttattcggggagagatcggagtagcggagaacggtgctgtctggataccgcaaaccgtgaagtataaagcgatttattttatttcggagaaactggtgattctgatcgaccggaataagattgtggataccatgtacgatgcttatcgcaaactggacggacaggaatatcagttcggtacctttatttccggcccgtcaaagacggcggacatcgaacaggcattggtcatgggagcgcatggagcacgggaggttttggtcatattgacgtaactccgctttattattctaaaataaatttggatttaaaacaatagaagcttagttttgttaggacaaagaaaaatggagcttctgtataagataaacaaaggctctgttgataggaaacagagcctttgttgttgatatatagagcctctgttttctgtctcatccatggaaagaactataatcgtctaaataataaaaacagtatgtatgcaaataaagtaaagaagatagctgccgttcatgacctttcggggatgggacgtgtttctctgacagtcgttattcctatcttatcctctatgggttttcaggtttgtccgcttcctacggcggtattgtccaaccatacgcagtatcccggcttctcctttctggacctgacggatgaaatgccgaagatcatagccgaatggaagaagctggaagttcagtttgacgctatttataccggttatctgggttccccgcggcagattcagattgtttccgatttcatcaaggatttccgtcagccggatagtctgatagtagccgatccggtgctgggtgataacggccggctttataccaactttgatatggagatggtgaaagaaatgcgtcatctgataaccaaagcggatgtgatcacaccgaatctgacagaactgttttatttgctggacgaaccgtataaagcggatagtacggatgaggaactgaaagaatatctccgtctcctgtccgataaaggtccacaggtggttattatcaccagtgttccggtgcacgatgagcctcataagacttccgtatatgcctacaatcgtcagggaaaccgctactggaaagtgacttgcccttatctgcctgcccactatccgggcacaggggatacattcacaagtgtgatcaccggctccttgatgcagggagacagtcttccgatggcgttggaccgtgctacccagtttattctgcaagggattcgggcaacctttggctatgagtatgacaaccgggaaggtattttgctggaaaaagtgcttcataatctggatatgccgatacaaatggcaagctatgagttgatataattaatatttataaacttttgtacttcagatatttctactatttttactgcctaattagtaatcatgaataaacatatctgatgactcaaacacttaaaacgactgaacggcttggagtagtagatgctctgcgcggatttgccctgctggctattgtattgttgcacaaccttgaacactataatctgtttttaccgctggattatacgttgccggcatggttgcagaccatagataagtatgcgtgggataccatgttcttcctgtttgcagggaaagcatacgctacgttctctttgttgttcggatttagtttctatatccagtttcataatgcggaaaagcgcggaacagatttccgtggacgatttgcgtggcggatgtgcctgcttttcctgtttgcacagttacatgccttgttctacaacggggatattcttttgctttatgcagtagtcggctttgccttgattcctgtttgcaagctcaaagataagacagtcttttggattgctgccatcttacttttgcaaccttatgaatgggggcgtgccatctatgcaatgatcaatttggagtatgtaccgtcaacagggcattttattccttattataaacttgctcaggaagtgacatccaatggcagtttctttgaagtactccgttccaatatcactgacgggcagatgtatagcaatatttggcaagtagaaaacggtcgcctgttccagacggcagctttattcatgttcggaatgcttttaggacgccggaagtattttatgaaaagcgaagagtccttgcgtttctggaagaagatgctgacaggtgccatccttgcatttatccctctctattgcctgaaaacttttatacccgctttgattacaaacccgtctataatggttccgtataagattgctgttccgtcttatgccaactttgcttttatggtcattcttgtttctgtctttaccttgctttggtttaagaaggatacaggatatagctggcaaagtctgctgattccttacggtcgcatgagtctgacaaattatatctcccagtcaatcatgggagtaaccatctattacggattcggactgtcaatgtacaagtatgcaggagcaacgggaagcctgctgattgcattgcttatcttcactattcagttgatattcagccgctggtggcttgcccgtcataaacaaggaccgttggaattcctgtggcgtaaaggaacttggatttagaatcttataacgactgacgggcgcttattattctcaaaccattctcatcgcaatgagaaaaaattctcaaggctatgagaaaaaatactcattgcgatgagaaataattctcaagcctatgagaatcttttctcatgggcttgagaactttttcttattaaagtgagtataattcttgttgtattcatcattcataagaaagctaattcataaaaagtcagctctcataagaactctgccggctatattacttgtggaatttcactgtgatttctgccgattggtttccgtaagtccagtccggaccttcttgaatcaggcgtatggcctccttatccagagacttgcaaagactttccttgactttaatgtcgaagggacgcccttctttgttaacaaagaaagtcaaggtaactttgcctttgacttctgcgcaagcatcgtccgcagggtatgccagattctttttcagatactttttatattgcttcatgcctgttacgggttccggaacgacaggaccctgtaaactatcggccttttgggagataacagcgtcttttaatgtatctgatttctgcaatgcacccgaagcttttttcaaatctttgatggatacggcagaaatggctcctgtcacagctacctttttctgtgcgccatatcctgttactacgacttcatccagtgttgttttattttcactcatggctataagcatattcttactggtgtctgccggtatactaaccggattatagccaatataatgtgcagttaatatttcattaccttcctttttgggcaaggagaattctccgttgatatccgttatcgctccatacgttgctcctttgtaagtgacgttagctccgacgagtggttctcctctgtcgtccgtcactttccctttgatcatgttgttcatttgggtggtcaattgagctgctttcatctttttcctgttggcatctaggaaagaagtatctgtaaccgttgtgatagccgcttcttccagctcttctgccggagcaaccatttcttccattatcggagttccggcaggcgttgcttggggagtcgctgctttagaagccactgctttaggaaccgttgcggaaggagcccccgaaggtgtactttgggatggagaatcctgccttgtcttggcgattatatcttttccgaccgtttcctttgtggcagaaggacgaccggaatccggttccatctttggagcggatagggaagtgtcttctttgtgagcaggaacagttgcagtggcggcgggctgctctttagctatgaacacatcctctccaacattctgtttcagaaacaggaagtaactgctgattccgattcctataatcaggcaggcggcaatgctccaggtgacggcatacgtatttcttttctttgccgaatgggcgtttaccttcatccgcaatttattaatctgttcttcgtggtccccttctacttggtggtacccatccatcgcgtcagccagaaaagggtctttcatcgactctttttccagtcgatgcgcctcttttcctttgcggagtcctcgtatgtagtccaatagtttcatagggcttgtttcttaatacaaattttcaagtttcgctttccgttctggatatagcttttcacgttattcagagtaaatccggtttgttcgacaatatccgcatacgacatttcttccaggaagaaacgtgtaatgctggtcctttgttcttcgggcagcttttccagacagtggtgcaatgctttcagctgctcttccgaactttcctcttcacttaatagatgcagaaattcgtcggattccataatattaatggtataatccagcggaatttctttgttttcctttcgtaacagttgcaggcaatggttcttcgccacccgatagagccacggcttgaatgcttttatctcataattgatgattttaggtaacaggtcttcaaacatctgcatcaccgcttcctgcgcttggtcttcatcttgcagatatttcaggcaaagtccgtacgtcagcgggatataacggttgtatagttcaccgaaatattccgtatccccggactttatataatgggtcagtagttcctcgtccgatagcttcgatatgtttcgtacattgaacagcactttctctattcgtcgtcttctgttactacctgatatttatctttcatcatctcaaaatcatccgttatctgttttagaatctcatgaacgtctgtgcttccggctacggcaggcgttccgtaaaagatggatgccttgtaaggcaataagattaattctcccttggggagtgaacgtcccatgccggtcatgaaaaccggtatatatttcagttccggtcgcagagacaagatacgggctatgccggactttatttttcccatttgttcgggcttccctcttgtaccttcgggaaaaagaatcagcgagtatccttcatcgatggcatcgagcattttccggagtgggtcgtgctccgagtccttttctccttttcttctgatgagaagggtgttgatgaagtaattgctgaaagcggcctgaaaccgggttcttccgaagtaatcttccgcggctacgggttttattttccacaaaaggttgccgggtagggaagaaagcaggctgagtgtatccagatggctgttgtgattggcaaggatgatgaattgtccttcttttctgaggaatcgggtatcggggaactggactcccacgatcagtttcagaaaccaccggaatatacctttatatagtatctgcatcatggcagactgcatgaatctttttttcatagtatgccggctaataagctatataataaacgaggtggaagaacaccggagctgtataggacagagagtctatgcggtcgaatactccaccatgaccggggatgctatctcccatgtctttgatgcctttatcacgtttgatggccgagatgactacatctcccgcaaatccggcaatggcaatgagggcgctgaccagaattacgttgggcgtggagagcggagtgaggaatcccagaaagtatcctataaccgtagtgctgacgacacctcccaaaaagccttcccatgttttgttgggactcactttgggcagaattttgtgacgtccgaagagttttccccagacgaactgcatgatatcgttgatttctgtaaggaacacgaggaacatcagcagtccgcgtcctcccgcattgaagcccggcaattcgggtaacgagagaagataagcgaggtggctgataccaaatacagaaagcatcagaatccattgcagcaaagcgatggatttagtgattccgtgtgtatcgcctttcaataccagtcgtaatggcaataacaggaacataactacggggatgaatatgatgtatgccccataccacgcgatataagcaagatagtattggataggaatagccaatatgccccagaacagtgcacggcggtctgcctctctgaatcctaataccgaataaagttctctgaatgctataaaagagagaaatgcaagaaaaaaataagaaatgtcgtagctgatgaaaacggcaccgataaacattgctgccataatccaccatgagcgggtacgggcaaccagttcgctgatattggttttcggcgacagcttttttaccagaaagagggcgatgcttgccgtcaccagcaaacagataataagggtgattacaataattaactcatcgcttagcgtagggaataatttgtccaatagttgtttcatttcgcttcgttgtttgtgtgagacataagatataaacggtgtataagagtggcgatcagaccgatattcattagtataagagtaatgaggcacacgatctgttcatatccccagtgaatggtgcaggtggcaatcacaaagcacagtgtcagtaaagccatgcgatgttgcttcgccatcgggccgttaaagaaatgctgttgtgtcttgtaagctcctatccagcggaaataagcggtcattacggcaagcagggcggcaagccatcccagttctatcccgaatcctccggctacatagcctacaggaatgataaacaaggcatcggcgaatcggtcgggcatatcattgtataaatctccgttggcacttttctttcctccttctatagccaccattccgtcaaacagattacatagtaaccgcgactgcatacagacgatgaacagaatataagcgacgtatttattgaaatcgggatagataacagtgcccgtcagcagaaggcaaccagccaaagcgaagaatacactcatcattgaaatctggttgggagtgatgccccaaccggttagtttacgggcgataatgttagcccaagcggtgtttcgtgaggctatttcccgccttccgtcgacttcatgtttcatttttatgaatgtttattgttcgcaaatatacacatcatcttagaagcagcaaaagaatgaaggattattttgaaaagcgtgctattttcaatgaaaataaaaaaacttcagttggtttatggaatccgtgtggaatctgcatctctatagtaaaagcggattaattgtaacattttaaaaagataaagttatgaagacaaatcaactcagagcaatgatgctcacggtgatgttagtgattactacattgggtggtacggtatgggcacagcctttgatcgtaaagggaacggtgacggacggatcagacggttcgccgttggtaggatgtgcggtgacggtcaagggaacatcccgtggagctgttacgaacctacaagggcagtacaggattgaagcaaacaaaggggaaactcttatcttcagctatattggttttgataaagtggaaaaagtcgtattctctgcaaagatggacgtaagtcttaaggccagttctgatgtattggaagaatgtgttgtcgtcggatacggcagccagcgaaaggtagctgttaccggtgccatatcaaccgtcaatctggcaagtctcagacacccgtccgtacgtatggatgcagtaaatacggaagaatataaatcgatcagtgaaaatggttttaagcaggtaggagaatctccgctttctactttctctattgatgtggatgccgcttcttacagtaatatgcgtcgtatgatcaacagtggtaccttgccggtgcctgatgctatccgtacagaagagttagtgaattatttctcctacgattatgcgaagccgaccggaagcgatccggtgaagataacaatggaagcaggtgtttgcccctggaatgctgatcatcgtctggtacgtatcggactgaaagcaagggaaattccgactgacaaacttccggaatctaatctggtattcttgattgatgtatccggttctatgtggggacctacccgtctggatttggtgaagtcatctctgaagctattagttaataacctgcgtgaaaaagataaagttgccatcgttgtgtatgcaggcaacgccagcgtaaaactggaatctactccgggcagtgacaaacagaaaatacgtgatgcgatagatgaactgacatccggtggctctacggccggcggagcaggtatccaactggcttataaagtggctaaacagaacttccttcctaaaggaaacaatcggatcattctttgttccgatggagatttcaatgtaggtgtttcttctgtggaaggtttggaacagttgatagaaaaggaacgtaagagcggagtattcctgagtgtgctaggttatggaatgggtaactataaagacaataaaggtcaggctttagcagaaaaagggaatggaaatcatgcttatatcgataatttgcaggaagccaatcgtgtcctggtgggtgagtttggcgctacgcttcatacggtggcaaaggacgtgaaactgcaagtggaatttaatccggctcaggtgcaggcatatcgtctggttggttatgagagccgtttgctgaaagacgaagactttaataatgacgccaaagatgccggagaattgggagccggacatacggtgacagctttctatgaagtgattcccgtaggcgtaaagaatgactacgtaggaaagatagatgatctgaaatatcagaagaaacaaaaagagacggtgcagccgaccggttctaatgaattgctgaccgtgaaactgcgctataaagctccggataaggatgtcagcaaaaagatggaagttccctttgtggataataaaggaaataatgtttcttccgatttccgtttcgcttctgctgtggctatgttcggtcagctgcttcgggactctgacttcaaaggagaggcaagctatgataaagtgatcggtcttgccaagcagggactggataatgatgaaaaaggatacagaagagaatttatccgtttggtagaaactgccaaagggatgaagcaggagaaaaccataagtgattaacggttacaattaggaaagagtgtatagatgctataggaaggtatctaagtgttaaagaatcaatttaaagggcggatttatctgcaatagttttgctaataaacaaatgtttattatgtttgtactgtgtttttaaagcgatgtttgacaatcaggaagagctaaaggctcacatagagcatgttaagcgatgcttgcagttctatgctcaaagtgtggaggaattgttgaagcaaggatacccacaaagagagttagagaggttgatcgatattcaactggataagctgatcgaactcctcaaacaactgaaagactaacattaacctcctcatgtattgaggggctgctttaaaaactcaatcatataaaaatgtttgttatgggaacagatagagagataaataatttgttgaatgaatttctccagctggagacagatgaacaacggagacagttccagggtaaaatagctcataccttatcagggaaaacggaagaggaaaaacgtgaatttgctgagattctttccaataaagctcagcaaacaatagaccagtcacaagcgttgattgatgaatatgatttcaagcaagcattgaaagatattgttccggctattacttggtcttatattgctgaagaatattttaataagtcgcgttcttggttcagtcagcgtatgaatggttatcatgttaataacaaggttgctacctttactgacgatgaaattgatttattatcagatagtttactcgatttgagtgaacgaataaagaaaagtgctttcctcttgaggaaacatcgcctttaaaaacacaactttcgaatgaaagcggcttccatattaaattggaagccgctttttatatataaaaatagctgtaagcattatacttacagctatttgaccttgcacgggaggagaggctcgaactcccgacacccggttttggagaccggtgctctaccaactgagctactcccgtgtttgcggctgcaaaggtagtataaacttccgaaccagcaaatattagggtaaataaatttccaattattttaatttttcccattcatcgggcttaaaacctaccagaacgaaactgtctgtcactactaacgggcgtttcaccagcttaccgtttgttgccagcaatgcgatttgttcttcctcagtcatggaaggcagcttttcgctcagtttcagctctttatataccaaaccacttgtgttgaagaatttctttattggcaatccacttcgtggaatccatgctttcaactcttccaccgtagggttatcttccacaatgagccggttagtgtactcaatgttattttcgattagccatttcttagctttctggcatgtactgcacgccggatattgcaaaaataaaggtgtcatactatatactatttatcgattaatatctaatacttattacttaatacctattacttaaattaccatctgcaaatcctgatacataatccgataggcggcggcttttttatctaatgcaagcgggtacgcccgtgaggaagaaggcatccggtagagtctcatcgcccgtccttcaaacacaaattcggcatagtctcctactttcggttcttccacttccagttgtgcacggagcgtatccgttgccttctgtccggtggtgacgatcgctctgcattcgggcagttggcggagtaatgcagcaatgtccgtcggttgcaccacttccagaaatttgtccgaagcgttatcctgcaaacgccggatagatgaggctgtatcgaacagggcgattcctttttcattcaggaagtcaataatctgttcccggcagaatgctttccgcgtatcgttcagaaagtgatctttgtctccgaaaaacaagagtccgacaatgcgccacatatcattgttcaggttcggataataaaaatccatcgaccaccgttttctttgtggcggaaaacttcccagcatcagcaactttgcttttggtgggagaaagggttttaaaggatgtttttcgatttcaatctccatattgatgtaatttcctacaaaaataacgaatctattcttttccttcaaaatagttgcggaaaaaaacaaatttaaaaatatttggctatttttgcacggagatggtgaaaaacaacttattgaaatgctgttgaaaacaagaataattataagttgctgttttataagcttgttatctttctttgaagaagattgttatgcttcacggccggggtcgaaagaatgtgtgaaagtctcctctgccagttttacggtaagggggcgggtcatcgatacctatggtgaaccacttatcggagcgacaatcagagagaaaggcggagcgaatggaacagtgacagatgtggaggggaatttctttttattcgttccggatagtgctgttctgcaaatttctttcgtaggttacgagtctcaggaagtcagtgtaaagggtaggtcaatgcttgaagtatgtctgaaagaaaatattctgctgcttgaccacgtgattgtaactgctttgggacttgaaaagaaagaatcctctttggcttatgccgtgcaaaaggtgaggggagaagaactgaatcgtgtgaaagaagtgaatatgatcacggctttggcaggaaaggcagccggtgtacaggtcagcaagaactcttccggcatgggcggatcggcgaaagtcagtatccgtggggtgcggtcggtggccggtgataatcagcctctgtatgtgatagatggtgtccccatgctaaattctacttcggaacaggcttattcggctatcggcggtacggcaaatgccggcaacagggacggaggcgacggcatctcgaatctgaatccggaggacgtggaaagtatcagcatcctgaaaggagctcctgccgcagccctgtatggtagccaggcggccaacggagtcattcttattactacaaagaaaggaaataccgtaggacggagggatattcatttctctaccggactgacttttgaaaaggctttttctctgcctgaaatgcagaacagctacggagtaagtgatgtaacagacagttggggagaaaaagaaaatctgacggtttacgataatttgggtgactttttccgtaccggactgacgtcgatcacttctgtatccgtcaactcaggaaatgacaagctacaaacatatttctcctatgccaacaccaccggtcgcggtattctgaatgaaaataaactctccaaacacaatatcaatctgagagagaccgccgtcctcttcaacagcaggctgaaactggacggtaacgtgaatgtcatgaagcagacggtgaagaataaacccgtatcgggaggcttttatatgaatccgctggtagggctctaccgttttcctcgtggcgagggcttgtcttattataaggagaactatgaacgttatgacgaggacagaaagctgaatacacaaaactggcatacttttaccgaagactttgaacagaatccgtattggatacaaaaccgcatacagagtaaggatgcacgtatccgcctgctcctttccctttctgccaatttgaaagtcactgattggctgacacttcaggctcgtggcaatctggatcactcagccgataaactgcgtcagaaattttatgcctccaccgctacggcactctgtgggatgaacgggcgctatattgaaatggattatcaggaaacgcagatgtacggagacgtgatggcgatggtcaagaagcaactgaatgacttcacattggacgtagccattggcggcagtatcaatgacagaatcactaactccactcgcattgattcgaagaatgcttcgttgaaatatgccaatgtgttcaatcttgccaatatcgtgatgagcagttctgccagtatcgatcagaaaatagatgcccattaccaactgcaatcggtctttgcgacggcacagattggctataaagaaggagtcttccttgacctgaccgcacgtaacgactggtcgtctacgctggcttacacgaaatatgagaagaaaggattcttttatccttccgtcggtgtctctttccttccggataagtgggtaaagatgcccgaatgggtttcgttctcgaagttgcgcggtgcttatagtatcgtaggcaacggggtgcctccttttatcacttaccctgtttcgtatgtgactgccggtggagagatactggcaagcgatgcggcccctttcgccgagatgaaaccggaaatgacgcattccgtcgaattgggcatggaatggaagttcttgcagcaccgcctcggattaaatctgacctattaccgtaccgacacgtatgagcagttcttcaaactgcctgcgcttgcgggggataagtatgcctatcgatacgtcaacgccggagatatccggaatcagggatgggagataacgctggatgccactccggtactgacccccgacttcacgtggaagacctctctcaacttctctgccaataagaataagattgtagaacttcatgaagaactgaaagaatttgtttacggacctaccagcttctcgtccagttatgcgatgaaactggtgaaaggcggctctatcggcgatatttacggtaaagcctttatacgtgatgaagcaggcagcatcgtttatggaacggacggagactataaaggacttccgttggtcgaaggcgacggaaataccgtaaaggtgggcaatgccaatccggattttatgctgggatggaatcattccttctcctacaaaggttttagcctttacttcctgcttgactggcgctatggaggtgaagtcctttcgcagacccaggcggagatggacctctatggagtatcgaaagcgacggcacaagcccgtgataaaggatatgtttcgctggaaggccagcaaataagcgatgtcaaaggattctataagaatgtagtgggcggacgtgccggagtgacggaatactatatgtatgacgctaccaacctacggttgcgggaaatatcgctgagttatagcttcccccgaaaatgggtacagaaaacgaattgtctgaaagacctgcaactttcttttgtagcccgcaacctttgttttctgtacaagaaagcgcctttcgatcccgatctggtactttctacaggcaatgacaatcagggaattgaagtgttcggtatgcctaccacccgcagtctgggctttactttgacatgtgaattttaagagtaggagggaagacgatgaagaaaaaacatatttatatatacttgctggggatgctgctgctttctgttggctgtacagggaaattccgtgaatttaataccgaccagtcgggagttacggacgatgatttgctgattgacgacaatggttacggtattcgtctggggattatccagcaaggcatctactttaactacgatttcggtaaaggcaagaactggcctttccagttgatacagaatctgaacgcggatatgttctccggttatatgcacgacggaaaacccttgaacggaggtacgcataactcggattataatatgcaggatggctggaacagcgccatgtggacacatatgtattcgtatatctttccacaaatctaccagtcggagaatgccacccgtgatacggaacctgccttgttcggcattaccaaagtgctgaaagtggaagtcatgcaccgtgtgacagattattacggccctgttatttataagaatttcgcgaatgcccagaatcaatatcgccctgatacgcagaaagaagtctactatgagttctttaatgaactcgattcggctgttgtctctcttgccgattatatagaaaagaagcccgaatctaatggattcacccgctttgatatcttgctggacggtcaatattcctcctggatcaagtttgccaattcgttgcgtatgcgtctggcaatgcgtatttctgcggttgatccggataaggcacgcaccgagttcctgaaaggactggaaaatgaatttggtgtttttgaagcggaagatgaacgggtagcggtctctacgaaatccggattcacgaatccgttgggagaactcaaccgggtatggaatgaaacttatatgagcgctgcaatggaatctattctgacaggctacgatgatccccgactgaaagtttactttgaaacctgtaccgacaaagcgtatgcaggagagtaccgcggcatccgtcagggaacctgctttgcgcacaatcattatgcaggcttatccaaattgtccgtcgaccagagtacggatgccccattgatgagttccgctgaaatctggtttctccgtgccgaagctgctttgcgcggatggataccggaggatgaagaagaatgttatcaaaacggaataaaggcgtctcttcatcaacgcggcatttatcagatggacgactatctgaacagtgagcggacagctgccgatttcatcgacacacaagaccccgaaaataacattcctgcccgttgcctggtttctcctaaatggaatcccgcagacgacaaggaaataaagctggaaaagatcattacgcagaaatggatagccttattcccggaaggttgcgaggcatgggcggaacagcgtcgcacgggatatccccgcctgtttccggtacgcttcaaccatagcaggaacggatgtatcgacacggagacaatggtacgtcgcctcaacttccccggcacgctgcaaaccgaagacagagagcaatacctggctcttgtggaggctctgggcggacccgatcatggaggtacccgattgtggtgggatacaggaaataatagtctggattaaaattttagtgtcggaatgtgaatatatgtataggtttaactatttttgcaccttcatttaaacacatttgtcatgaaaaagatcatttctgctcttttcctatgtatgctgctttctgccgtaccggaattgcaggcacaaaacattcagttacattatgatttcggacgttccctgtatgataaagacttgaaaggacgcccgctgttgacctccactgtcgagaagttccatcccgacaactggggaagtacctacttctttatcgatatggactatacgtccgaaggggtcgcttccgcttactgggagatagcccgtgaactgaaattctggaaaggtcctttctccgcccatctcgaatacaatggcggactggcgaaaggattctcctacaacaacgcttacctggcgggagccacctatacctataataacgcttctttctccagaggcttcacattgacagcgatgtacaaatatatacagaagcacccatccccgaataacttccagttgacaggaacatggtacatgaacttttgcaaggatttgctcaccttctccggttttgccgactggtggcgtgaagaaaccaagtatggaaaaaccatcttcctctccgaaccgcaattttgggtaaacctgaaccgcatcaagggagtgaataaaaactttaacctgagtgtcggttccgaagtggaactgagcaataatttcggtggtcgtgacggcttctatgtaattccgacactggctttgaagtggacgctgaactaaacttcgaagtacaaaattccccaacggatatacatcaattattgaataaaaatatcgaatgaaaacagatttgatctatggcgtagaagaccgccccccatttaaagatgccctgtttgctgccttgcaacatctgctggctatctttgtagccatcattacacctcctcttatcattgcgagcgcactgaagctggatgttgaaaaaacaagctttctggtatctatgtccctttttgcttcgggggtatctacgtttatacaatgccgtcgtatcggtccgataggagcgaagctgctctgcatccaaggtaccagcttctcctttatcggtcctatcatagcgaccggattagtaggcggacttccgctgatattcggctcctgtatagctgccgcacctattgaaatggtcgtcagccgtaccttcaagtatcttcgtaatatcatcaccccgctagtgtccggcattgtcgtactactgatcggattgagtctgatcaaagtcggtatcgtttcctgtggcggcggatatagtgcgatggacgacggctccttcggttcgtgggaaaatctgtccattgcggcactcgtactgttgagcgtcttgtttttcaatcgctgcaaaaacaaatacctgcgcatgagttccatcgtgttcggtctttgcctgggttatggactggctttcgccctgggaaaagtaaatatgagcgcactaaatgtcgagatgctgatgagtttcaacatcccgcaacctttcaaatacggtattgattttaatatctcttcatttattgccattggcttggtctatctgatcaccgccattgaagccacaggagatgtgacagccaactctatgatttccggacttccgattgaaggtgattcttatctgaaacgtgtttccggcggtgtgatggcagatggcttcaactctcttttagcaggtatattcaactccttcccgaactccatcttcgcacagaataacggtatcatccaattaacaggagttgccagccgctatgtaggctattatattgccgctatgctcgttctgctgggattattccccattgtaggagctatattctctctgatgcccgatccggtactgggaggcgccaccttattaatgttcggtacagtagcggcagcaggtatccgcatcgtttcctcacaggaaataggccgcaaagaaaccttagtcttagcagtcagcctatctttaggtttgggtgtggaactaatgccggacgtattaaaacaagctccagaggcaattcgaagtattttctcttcaggaatcaccaccggaggtttaactgcaattgttgctaatatggtaattagagtgaagtaataggtaataaataataggtaataagtaatatgccatgcgggtaaagctaccggcagctacgattattacctattacctaatacctattatttatttctaaattactcattttatctgtaatccgaaaggggaaatctggatactcgtagaggctgaaacgaggttcggtttccccttttgtatagctccagatagaagcgtagtcttccgggtcttcccccatcttgctgagttggcgtagataagctgccagtgatttattctctacgatatagatttgtcccatctgatcgataatagggctatggtgacgggtaccgtcatgttcgaagcgaagaattcgtttgccttcctcagtcaatcctaccaattggaaagtcatactcttgccgatagcaggcagattcagtacactgcggtcggtagcaaggaaaggcagatgatgctttctcatgaaccgtcttatttgtttggcggtgtcagcatcttctttcgttttttcttcatttatacctgcactgactttggtctccagtatcttatacaattcttccgcctgttccggagtcatctgtccgtaaattttctcttcctgctgttcctgcattgagcgactgttgggggcaaacaccgcataattctcattaaatcccttcaccgagaacgtataataacataccactcccagtgaattgagtacctggcgaagccgcgtagtatgtcctctgcgtgaggcagccaccgtatataccaactggttcgtaataatccatccggcagaaagaatcttccgaattgcttctttagcctcgggggtaacctccagcggtgtctgaaaatgagtctgaatgataaactgcttgacgccaacagccgaagccttttccttaaactcccgcaaaatgtcaaccaactcgtcattaatacgcatcggcaaataagccaataaacgagaacccagtctcacccgttgcaattccgcatatttctcaccttccggacgttcaagattcgccctttgtttgcgtaccgccatacgatacaccgcttctaatatattcttcaacgtcttattctgactcatcagcgcatcgcctcccgtaatcagaatatcgcgtaactgcgtatcctgttcaaaataggtcatcaaccgtcgcaacttactgtcccacgactccttcggtcgtaacgtctcaaattcaaaattcagccgttcactctgaaagtcatacatacgctggcaagatgcacaaagccctccacaagcccgtcccatcgtatcaggaataaggatagccacctccggataccgtcggtgaatattatgtccgtccggcaagagccatccggcagcattcggctttcctgcctccacaatatcttccttctcccatgcacgaatattgccatacgtctccactaatcgtggcgaataaagtatataactccgaatcgcttcatcattatacccataccccgtcacattcagcaacgacaaataataaggcgtagcaaagaacggcattccctttttacgtgcccgattcaacaaatacatcgtctccgacgaaagtgaatttcctaaaaagcgattcaactcagccggacttttcacagccatcgacaaatgaaagcggaaatctccccaccatttgcttaccaactgatacttctcctcataactcatcccttcctcaaaatggaaccgtaccgaaggcttcgacttccggttctcaatcttctgaatcaacagatgcagcatccgttccttattctcatcccgcatctcccgcacttcctcatccaatccggtatcccaccggtcattccggctcttgatgcgctgcggagacggcgaaggaacattttccccctgcaaacgtttgaacaactggaacaattctacaaacaaatccgtcggcatctctatattctccaacttctccgtcagaaactgataaagcaaccgtatcgtctgtaccgaaatatcctgtcccgtagacagttcatgaacatcctgtccatcatactggagtaagagtcgaatttgctcccttgcctcctccgcaacctcattaaccatcccgcaactatccagatgttttagcagaccagccttaaagtcctccactgtcggactcaccgccgccatctctaccaactccggcatctcctgcgtgtatatttgtttcaactgcgaaaaagtaagtacaagcattttcttttgtttcataagcatcctctatattattatattatttattgattagtaacgacctatccctccgcaaggttcccccggcctcgactgcccggcgtcaagcgcaggtcttatttacggcgttaaaaagggcagactgtttgagcgaagcgagtttctgccctttagccggaaatgagaccggagtagccgggcaggcgcagccttgattttttctttttggtactttttcttttgcatcaaggcaaaagaaaaagtacataaagataataaaaaaagcggaagtatgccactcccgcttttcctgctatgctattctttacgattttctaacatttacgcgaccttattttttcgtttccgtgtcgtcgttcttccttttcggttcctttttggcaaggagcactatattatatacatagtccgtcatccactgttccgaataccccaggcgttccttgtattggcggacagtcgccgcagtcttgtgcacatcatcagccttccacaccgtcttcgtacaaacatcgtgtaccgtcttctgcgtcatcccgtaaagcgccttcttgaatatagacggcatacggaacttccattgcatcagatttcccatcagcatcatcaagtcgttggaaaaaccttgatacataaacagatacgactggatatcattctgcgtacggcaattacgcttcacggagctgtcgatctccttaaagaaactttcattcagtccgtagtcctgcatcagcattttgcgtgaagctgacttttctgccagtcccagcttacctccctgcgtaggaatcttgaacaaacgtttgaagttagccacatccggtaaaaagcggatgttggtaatacctaagttagtagcgatgactgactggaaataaacccgggtcagtgatatgaaatcttctacattgccgacttttgtttcatcggatttctttttgaataaaccaaataagcccatcgttatatttactattttataatttacaatttacaaatcgtgtgtggagattttaatgagccgcaaaggtacgaaaaagtgttggttttcaccaacattccaagtccttttcgatgtccggcatggtctctttcctgaaaacaggactttggatgcccgctttcttctgggcacgatagtccgagagcaggcggatggcatactttccgagaaagataatggcgatcaggttgcagacagccatcagagccatcgtgatgtccgccagactccataccaaatcgagtgtggcgacagacccgaaaagtaccatgccgctgaccaatatccggtaggtgtggagcacccatttctttgcggtgatgaaacggatattcgcttcaccgtaataataatttcccaagatactgctgaatgcgaagaagaacaacgctacggcaacaaagatgcttccggaagcaccgatctcattcgtgagcgcctgttgggttagttgcaccccattggaggaaccgtccaaaggagcaccgctgaaaagaatgataaatgccgtacaggtgcaatttaataaagtatcggtaaatactgccagcgtctgtatcaacccctgtttgacaggatgagtgacgttggccgtcgctgctgcattcggagccgaacccataccggcctcattgctgaataatccgcgcttgataccctgcatcagcgccataccgacacctccacccaatgcctgttcccagccgaaggcatgactgatgatgagagatatcacttccggcagatgcgtgatattaagtaatacgatgaccagtgccagtcctacatatcctaatgccataaccgggacgataatgctgcttacatgcgctatccggcggataccaccgaagatgatgacaagagtcagagcggtaagcactcctcccaacaccgtatgattgaatccgaacgcatgttcggcagcagcacaaatcgtattgctctgtaccgaattgaaagcaaaaccgaaagtaatgctgatgagcacagcgaaaagtatccccatccacggctgtttcaatcccttcttcatataataagccgggcctccgacaaaagagtccttcccgcgtatcttatataactgtgccagggtagattcgataaaagcgctcgaagctcccagcagggcgatcacccacatccagaaaacagctcccggtccgccgatggcgatggcggtggccacccctgccaagttgcccgtacccacacggctggcaatcgtaatagcgaatgcctgaaaagatgaaacatgtttctcgccctgttttccttttccggcggactcgctgagtaatataatcatttcgcgaagcatacggaactgtacgaaccgcgttcggatgctgaaccagacggcacagcccagtaacatgataatcaggatgtatgtccagagtatatcatttatttcattgataaagttcatagttaggtttttgaaaagagtaaatcgtaatatatcactcgtttttcattcggaaataaaatttatgattttcgaatacgggctctactatatcataccgaacaaatttggcaagcagatgttcggcggcacgtcgggaaataccggtctgccgacaataccggttgagtgaaagcagcgttccctgttccagcaggtcgagcaggagttgttcgcgttccgtatagcggatcagttctccccgcgggctgccactttgttgccatacacgcaggtggataggggtagccagtatattctcatccttgatgcggagataggcgagaggctttccgttttcgtctttcgcatagacaggcttgtgcggattctcttcgatggtggctactaatacctgtttgccttccacgatatatgtttgtaaagtataatctatctccgggatgcaataaagttgtgcggctgcttcaatcatatatttttcctcttcagatcgtacgccggctattcgtccattgtctttcacgccgatcaatagccgtcctccgtcggtattggcaaaagccgacagcgttttggcaatcttgcgtgcgtcggaaatttcgaatttgaagtcctgttgctgatgctctccttcagctatcaaagtatgtatgtgatccgtatcagtaagcgttttcatggctacaaaggtagggaaaaatggtgaaaagccttttttttagcttattttcgcagataaattcaaaaaaaatattgtttttatgcgtttatttcgggaaacagtgtatttttgcgacacattattaacgaaaaaaataaaaggattatgaaagaattggtagaaaaagtagcagctctgtatgctgacttctcaaaagatgctaacgctcagattgaaaacggtaacaaagcagcaggaactcgtgctcgtaaggcttctttggaaatcgaaaaagcaatgaaagaattccgcaaagcatctttggaagcttctaaaaactaagaaatagaagtctactaagatatcaggaaaaaagaagaggatgtgtcgtgagatgcatcctcttcttctatttatacctccttctcttttctgaaacccgaaatatcggacgaatgtgctatttttaagattacattgaaaaacggtcactctaaaaataacgaactagagaaaaatctgcataaataaatgcaataatatacgaaaaaaaaacattctttgcatgaaactacatgaaatatacaccttttcaaaacaaaaaagtatcttttggttttaaaccaagggggtgtttctttaaaaccaacgcctccttcctcaccgaccaacctgttttccgtcggtaaggaagacctgaaaaagctgtttttgcttaattttcttctaattgatccataaataccgggaaaataaaagtgtcattcggaactgtttttcttcagtaagcgatcagaatgatcagtgaaaaagaattatacttctgatttgaccgataaactctttgaatagtaaaaaagaggaatcctgtatttgtgaatgatggcatttttatgcctttctttaaagtgggatacaattatgcccttctttcactgtttaaatattccttttttaagaaaggtccttttttagtgatcaatagatgtcgctatatgtgaaaagttattcatggtaatttgaataaatgaactcaatctttccctatttgttgtttcgtttttcggtgatactgattttcggagtgtcttattctgaaaattggtcgtgtatatgcgtattaggcaattatagttgctgaaatatgtgtatatttattgtgtaatatttaatactgagtacaatgttaaaagtagtagcatttatgaagcaagtagccgaagagctacggatggggggaaactttggtacggcgcacgtatatcgcagcagcaccaatgccatcattgcttattgtggggaaggggatttttcttttgacgaggtcaccccggagtggttgaaaggtttcgagatacaccttcgtgggaagggatgtagctggaacaccgtttccacttatctaagaacatttcgtgcggtgtacaatcgtgccgtcaacagtaggatggtcgtttatacgccccatctgttccgctctgtttatacgggcacgcgtgcggaccataagagggcattgtgtgatgaagatatgaagaaggtattcaccagactgccttcatcttccgccatacctcttgccgtgaggcgtgcgcaggacatgttcgtgctgatgttcttgcttcgtggtctgccgtttgtcgatctcgcttatctgcgtaaaagtgatttgagggataacgtgatcacttaccgcaggcggaagacaggccggcccttgtcggtgacgcttactccggaagcgctcgaactattaaagaagtatatgaaccgcgacagccattcgccctatctcttctcactgctgaaaagcggagagggaacaaaggaggcttaccgggaatatcagttggcattgcgcagcttcaaccagcagctcacgctcttgggggaggtattgggactgaacgataaactgagttcatacaccgcccgccatacatgggctacaacagcctattattgcgaaattcatccgggtattatctccgaagctatggggcactcgtccatcaaggtgaccgagacttatctaaaacctttccgtaataagaaaattgatgaggctaataatcagattattgattttgtaaaacattcaatagctggagtagtatcttgaaaatgaatctgttactttctaggtaacggagctaaatagcgttgcaaagatggatatattttggaaaacatgcaaacaaaaaagatattttttctgataaactactaaaaaaagagaaataatacgataaaacaacggatttctttctattagggacctgttaacctctgatcaagatacaaagaatttcctcccctctgccgcatgtctgaagcaggggtaaatatgtttcactgtaaaatagtctggtttttcatatagatagctccacaggagtcaggacaaaggtttacccgttacctagaaagtaacgggtaaaggctgtttggcccgtatgcttcatagtgtattatataagggaaataaaggttgaatgaattaagaaaaggaggtcgcacgagaaatgaacggaacaacacatgggatttaaaatcaaaagtgagaaattatatttttattatttttttaatttataaattaaaagttttttattatgaacaaaaagtttttaaatgctgtcctgtttggagcgctgatagcgtcctcggcaggtacatttacttcttgtaaagactacgatgacgacatcaagagtctgcaggaacaaattgacaaaagcggaagcaccgttggcgatcttcagactcagctgacaacgctgaagagtgctgcagaagctgcacaggctgctgctgatgctgcaaagacagctgctgcagaagctaagactgccgcagaagctgcaaaaactgccggcgaccaggctgctgccgatgctgctacagcgaaagcgctggcagaagaagcgaaagctgccgctgcgcaagcaaaagcagatgcgatagcggaagccgcaacacaggttgaagcattgagaaattcaatgcaggctgctattgacaacaaactggatgtgacagtacacgaagctgctgtaaaagcactcggtgctcagattgaaggtatcgaaacaggtttgagcaatcttgccaacggagcagtgaaagaaaataccgaagcgatcaaaaatgctcaggatgctatcgaaacgttgattacagcagataaagacttgcagactcagctcgccgctttgaaactttatgcagaaggtgtaaaggatatagctgacgctaacaaggaagatatcgcggcagcgcaggaagctatcgaagctgcacaggatgagattaagaaactttgggatgaaatcaacggtgaaggcggtctgaaagctttgatcggtgagaataaatctgccattgaagcgttgaagaactctacagctcaggatatcgctgacctcgaagataagatcaacgatgagctggatgctatcaaatcggatatctcaggtattcagggtgacatcagaaccatcaacagccagattattactatcaacgctgacttggtgagcctgcacactttgatgacttgccgtctgacaagcatcacgtttgctcccgactatatcgtagacggtgtggaagcgatcaagttcaactcattgaaatatgctccgatgggaagcggtgaaaatgctgctattcctacgaattatagtatttctacagctgctttggcaactgcaagctaccacttcaacccggctagcttcaagttgggcaatgctgactatagctacttggatcgtagcgctacagtgatcaacactcgtgcggctgccagccagtgggttcagatcagcggtactccggttgctaacgctgcaacaggaacagtggacttcaaactgcttcgtcttaacgttcattctactcagccggcagaagataaagtaaacatggttgctttgcaggctactctgaagggtgatgctgtagacaaagacgagactaacgtagtggttacttctccgtatgtatctatctatgatgacgtactggctgcaccggacgttcgcatctctgataaagctactttagtttcaggtgctgacggtgctcattatgcaactactttcactgcttgtaagtcagaagctgttcgctatacaactccttacgatcaagtattcaacctgaaagacctggtggctacttgcttcggtaacggtaatcacaaagaattcccgatcgaagactataagttgtcatataagttctctgtagcttcttctgattacaacatcactgaaggtgaaacttcaaccaaccagcagaaatgggtggtatgtaacgacgctgcggcaggtttgtaccaggcagaaggcttcaataaagaagcgatcggtcgtactcctatcctgaaagtggaattggtagacgaagcaggcaatgtagtacgtcgcggattcgtgaagatcgaatttggtgtgacgaagcaagatgaccttgtagtaggtgacaaggcttatgacttggtagctaaatgtactgaaacagctgctgaatacactatcacagagcaattcatccgtgaaaatgtttaccgcgttattactaacggtaaggaaacaagcatgagccacgaagaattctggaacttgtatgatgcttccggtgctgttgctgtagtgaagaagaacaacctgtcacacactatgactctgccgagaatcgttgacggtgatacttcagtaggtactgctacgaagaagatcgtatggtcatttaatcatggtgaactgggtaagatcggtgccggtggttctcaatttgttgcaactgtaacagtgaagaacaagctgacttcttctgaatatcctgcaagcatcacattcaagttcacagtaaacgtgaagttgcctgaacttactttggatgctactgaaaatgatatttactggacgaaagatggtgatgagtacaagtacttcaatgtaaatgtgagtgtacctaactcagttgcttctcctgcaagtgattgtcagttcagaagagcattgacagaagcttactctgcttacactgtgaaaggacttccgggttgcgaatctgctcgttacaaagtaatcaagacttactctaacggtaacttgacttctcctgtaatgtctggtgttcagatcgacggtaactatatcactttggataagagcaatgctgctgtgaaggctgcgttgaacagcgcaaacggtctgcaagctgtcgttgcacacatctacacgatgagcaatggcgacgaagtgactgtgaacgaatttatggttgactttatccgtcctgttaacttgaacatgccgagcggtattgcagtaatagacgctaagactggcggtgatgttgctgacttccaatggaatggtctgttgactgactggagaaacgaagcaattgtgaaggatagctggtcatgggttgaaaatgttcattcttactggaagagagtttgtactcctgaattcgaatatgttcaaggtcacgaagaaatggttacaccggctcagttggatgtagaatatggtacgattaagtttactaccactactgtgactactatgtatacaggtaaggctacttatagatactataacagattgggtggatctactaagaagacttacacaactgaagagttcttgactcaggcagaagttgacgcctctcttgaagcacagaaattagctggatggccgttgatatatccacatgttgaattagatggcgatattatatatacggaagtttctaaacctgcaagcactactattgagtacgactatgtgaagagtatcaactacgtaccggcagtttacaagtgggttgaaggtaactggacaatggttcctcacaaacacactgaaaagcctgcattcgaaggaacatcttacggacagatctcaggatgttgggaatggacgaagaaagagtggggcagaccggattggaatcctggacaatactggttcttctatggtccgttcggcgatgtaacactggatttgaacaaagtaactacaagcttggaatacaacggtaacaagttgcctgacggtgctactttggttcaggaaggtaacacagtgaaatatgtaaatgttagctcaccagttggatatacttatcagatattcattcctgctacagtaaattatggctggggaactacttcttctacattgactattacagttaatccgaagaactaagaattgaaatgtcaatgaattcttagacattcaataacaaaaagggtgctctaatcagaaaagagcacccttttcaccataacaagtacattctgtggaatactctgtgataagacattaaatatataaaattatgagaataagaaatttactagtagccatacttactgtcagcagcacagtagcattcgctcaggaacagcgacaaatcaaggaagagggcaagacagtgttcaaacctcattggtttatgcaagttcaggctggagctgcgcatacggtaggcgaagccgattttacagatctgatctctccggcagcagccgttaatgtagggtataagtttgcacccgcatttggagcccgtttaggcgtaagcggttggcaggcaaaggcaggatgggtcactccttctcaaacctatcaatacaaatatctgcaaggcaatctggatatcatggcagatcttagtactttattttgtggttttaatcctaaacgtgtattcaacgcatatatttttggcggtgcaggattgaatcatgctttcgacaacgacgaagcaaacgcactggacacaagatctcatgaattagagtatttatggcaggacaaacaaaatcttatagccggacgtatgggactgggatgtgatctgcgcctcaatgaccggctggctatcaatattgaaggaaacgcaaatgcactgtccgacaaattcaactcgaaaaaggcaggcaactgcgactggcaatttaacgtattagtgggcctgaacatcaaattaggaaaaagctataagaaaacagctccggtatattatgaaccggaaccgatagtagaacaaccaaaaccacaacctgtcgtgaaacagcccgaaccggaatctgtggcagtggtagtggaacctatgaaacagaatatattctttgctctgaactccgcacttctccagaaagaccagcaatcgaagatcgatgcaatggtggcatacatggaaaagtatccggcaagcaaagttgccataaccggatatgccgacaaagaaaccggtaatccgagaatcaatatgactttatccgaaaaacgtgcgaagattgttgccgatgccttgaaagccaaaggaatagcggcggacagaatcgttacggatttcaaaggagatacagtacagcctttccgggtgcctgaagaaaaccgggtaagcgtctgtattgcagaataatattttcccacttctcatgcgggtatataccccattcctctattctattaataaaagtatgagggacctgtatgggaggtaaaagaggaagcccgtacttgtgaaagcccggacttctgcaatgaaccctttcttcacttgttagtgaagataaccccacaaggtgcagatggaaagcaatgcttgtgaaagtcttcttttccgatctctgttccttacagaggatgcccctcacatttttcccacgggcatcctcttttttatatatatagactgattttattataaagtctgattgttttgtttatagagaacaaaatatgagtgatttggttcgttatcaaccggcattccgattaaaatcgtatatttgcgtctgtaatcagattgggtccatgaacgaaaatgtccttactaaactaaagatacttgcagaatcggccaagtacgatgtatcctgtgcatccagcggtacagtgcgctccaataaaccgggcatgctgggcaataccgtaggtggatggggaatctgccacagctttgccgaagacggacggtgcatctccttgctcaaagtcatgctgaccaattattgcatttacgactgtgcctactgtatcaaccggcgcagtaatgatctgcctcgcgccacgttgtctgtctccgaactagtggaactgacgattgaattctaccggcgcaattatatcgaaggtttgtttcttagttccggtgtggtccgtagtccggattatacgatggaacggcttgtgcgtgtggcgaaagatttgcgtcaggtgcatcgctttaacggatatattcatctgaaaagcattcccggagcaagccgggaactggtgaatgaagccgggctgtatgccgaccgccttagtgtcaacgtagaaatcccgaaagaagagaacctcaaactgctggctcccgaaaaggatcataagagtgttttcgctccgatgaagtatatccagcaaggcgtgctggaaagcaaggaagaacgacagaagttccgtcatgctccccgttttgcgcctgcgggacagagcacgcagatgattgtaggggctacctccgagtcggataaagatatcctttacctttcgtcggcactctatggacggccgacgatgaagcgtgtttattactccggatacgtctccgtgaatacgtacgatacacgcctgcctgcactgaaacaaccgcctctggtacgtgagaaccgtctttatcaggcggactggttgctccgtttctatcagtttaaagtggatgaaatcgtagatgacgcatatcctgatctagatctggagatagacccgaagctctcgtgggctttgcgtcatccggaacagtttcctgtcgatatcaataaggcggattatgaaatgttgctccgtgtgccgggcatcggggtgaagtctgctaagttgattgtggcatcccgtcgtttttcccgtctgggcttttatgagttgaaaaagataggcgtagtgatgaaaaaagcgcagtacttcattacgtgcagggaactgcctttgcagatgcagacggtgaatgagctttctccgcagcgggtacgcagtctgctgcttccgaagcctaagaagaaggtggacgaccgccagttgatactggattttggggaataaatggagtttcagatgttgtaaaccgcaagataatgaacgtctatatctacgataaaacttttgatggtctgctgactgctgtcttcgacgcttattttcgtaagacctttcccgatttcctgttgtcggaaggggatgctttacctttgttttatgatgaattgcatacggtggtcaccgatgaagagaaagccgcccgcgtgtggcgtggcttgcagaagaaagtttcttcttccgcgcttggctgcctcacccagtgttggttgtcggaattgccggatatagggatggttatctttcgttatattcgtaaggcgatcgacgctccccgttctatcgagactaacttcggcgatccggatgtgcttctgcttgcccagatatggaagaaggtggatggcgaacggatgcatctgatgcagttcgtgcgttttcagaaagcggcggacggtacgttctttgctgccttcgaaccgcagtataatgccttaccgctaaccgttcagcatttcaaagatcgttttgccgatcagaagtggattatctatgatatgaagcggcgttatggcttttactatgatttgcaggaagtgactacgatttcttttgatgacgacagccgggaagctcatctgattacggggatgctggacgagagcttgatggatgaaaatgagaagatctttcagaagctctggaaaacgtatttcaaggctatctgcattaaagaacgcatgaatccgaggaagcacaaaaaggatatgcctgtccgctactggaagtatctgacggagaagcagaagtaggcttattctatccgctgcaccgtcacatccggaaatttctgcatcaacgaaagtaaatgtccttcatcattgttccgttttgatttgatgaccattgtgtgacttgataggattccatttcacccgaatgctgtgtttccatttcgtaagagacaatcatataatcttttgaattaaatctgtccgctatctgtttcaaggtgtctttgttgttagtagagaaggagatcatcgaacttttcatgcctacactcttgaagatgtaactgagtagttccaggccgatcagagtcagtacggtagtggctatgccgatggtgtacattcccgcgccgactgccagaccgatgccggctgtagcccatatgccggcggctgtggtcagtccacggacgatttgtttctgtaggataatggttcctgcaccgatgaatccgatgccgctgactacttgtgccgctacacggctggggtcgagcgtcacactgttttctttgatgatctcttgaaatccgtattgcgaaacgatcatgatcagggcactacccaatgatacgaggaagtgagtgcggtatccggcttctttggcacgatattcacggtccagtccgatgatggctcccagtattcctgccaccagtaatcttaacataaaatcaacgttcaacatcataggttcggtctcctttcttttctttgtttgtttcttctgtttttttctttaaaaacggttagtcctataaatatacaattcttttctctttttgtgctattaatttagtaatatttgaacgtagcatatgcattttatcgtatattcgcagacaaaaccgtgcattacgccaaagattgaataagaaatgaagaaaaggatattttacatcattagttttctggtgatattttgtatagaggtgttcatagccttgtatgtacgtgatagtttcatacgtccttatatgggagatgctttggtcgtggtgctggtatatagtttcgtacgtatatttatcccgacaggggtaccccgtctgccgttttacgttttcctgttcgcttgttttgtcgaagtgctgcaatattttcagttggtggaaactttgggaatcaccaaccgtgcattaagaatcattttgggctccacgttcgattggaaagatattgtctgctatggagcaggatgtatctttatctttctgtttgagcaaatattcagacgacgttaattggaataacagactttcttgtttggcgattgcttattgtacgttctctttatcttcgttttctgaagtcggattcagatcgtgtccgcaatacttgcagaactgcgcattgtcttcatgccctgaccgatggcagttcggacattctttgtctcttctccgtttgtagtccttcatcatggaggcggacacaatgccggtaggtaccgcaatgatggtataaccgatcagcatgacgcaagccgaaagaaactttcccagtccggtgacgggagttatatctccgtatcctacggtggtcatcgtgacaatagcccagtagatactgttcggaatgttattgaattgagaattgggcaaagttccttcgatcatgtacattaacgttccaatggaagtaaccaaaatcacaacaaacagaaagaagaccgcaatctttttactactttcccgaagtgcggtgagcagtcgttcgccttcattcaagaaattgaatagcttaaagacacggaatacccgtatcaatcgaaatgcacggatgataagcagatagcgtgctcccggaaagatcaaaccgatgtaaagcggcaaggtagccaacaggtcaacaatgccgaagaaactgaatatgtatttcttcgggcggggagagcaatatattcgtgtcagatactcaaaagtaaagaaagcagtgaaaaggtactccattacgacaaatggggtagtcagataggaggggagccctttcaggctttctataatgactaataatacactggcaaggatacagccgataagaaccacatcaaacagttttcccgaaggagtgtctgactcgaagatgatgatgtacagcttatgtttcagcttttggtcattcataaaataatggattctttcttttagtttcatgagaataatcagttgacaggccaatatcccaataacctgtattttacctattacttattacctgctacttattacctattacattaatctattacccagtgcttgttatatgcaaccgtcttctttggatcatagtacattccctcttgtgtaggtatctggagaacgtatgtttttccggtcctgttctttagggtttgttcgcgtagccaagggttcgcatctcgaagttgggcgtatgtgattccctgctgtttggcaaaatcgcttaagttggcaatgggggtggtgaccgttatctctttgtaggggataggcgggtacaggtgttcctttttcagcaggaatccatatcgttgaggattcttgaatatttctttgactgccagcaggcggaacatatagcgggaagtctcttctaccagccataagtccattgcgtggctggcaagttgctggtccagttgagaggaaattcgtccttgtccggcattataggcggcagatacagccatccagtctccgtatttggcataagcctgtttgaaatatttgcaggcggctaccgttgctttttcgatgtgataacgttcgtctacgttctcatttacttcgagtccgaattcccgtccggtagcaggcatgaattgccataatccggctgcaccggccggagagcgggctatgttgttgaggttactttcgatgaccatcagatatttgaaatcgtcggggataccgttcgctttcagaatcggttctataattgggaagtaacggttcgcacgcttaattagcagcatggtggtggagtgcatataggtgaacgccatcatctcccggtccatccgctcgcggcggtcgtaacggcggaggtcgatcgtctctccgtcaaaagtcacctgctcgggaacggtaggtgaggtgacgcaataaggtacttccgatttggcggaatgctgttcgtctacatgactgctaccgatcagaataggcagggtagctccgatgcagaacactaatataaaggttagaatgtagttgatcttggtaaatttcttcattttctgttttcttttagtcatttgattggttcttattccaatatctggcaaccacggcagtaatagatgctaccgccaagataattctccttgacaatggtttctccgcaacggggacaggctttgcctgccgtgtctttagagaggcaagctgtgtacttgccgttttctccgaacaggtccgattccgtgtttcgtccaccctgtcggtagatatcgttcatggtttcctttacttgatagaacaaattttctttctctttgtctgttaatgctgctatttttttctttggatggatgtgggcatgatacagaatgtcctgtaatacaccgtttcccagtcccggaacagtctgttcggtagccaggaaagctttggcggatttcttctgcgcactttcatcattaatcagtccgaggaaatattctttgctgaaagcgtccgacatgacctgcggcttgcttttcgctgtccggtaatattcggaaagcatgcccgtagcagcattcttgtcatagcacatgagtccgccatacattctcacggacgctataaggcagctttcatcttcgaatgcaataagtaactgatgtttggccggcagcttggtccctggagtcagatagcgcagatttactccgtccgtgagtacgagcactttatcttctattgtaatctctaccatacctccctgagactgcgcactgtttatcctcttatcgactagccattcggcaaactcatcggaattgccgttaaaccaagcgaatttgtgagggctgaattgaataaatacatctgatattctttttcctacaactgtctcagtgagttgttcgcagagataacgggcttcgggtgcttctatcatatagtctctatttctgattttataaatgttctcatgcaaatataatatttattagtcagaactaaacaaatccggtggaacaaaatcaggttgctgcaatatctggcctttattatcactgttaagaaatgaaatctcgatttcttgtgtaggataatgactatatgtggttggaggaaaagtatatgagttttgcaaagcgtatatataaatattcaaaacaaagtgaaggattcaaacttgttctaaagtttaatttcctccacgatgttctgaatatcaagttaaagtctagttattttatttgatatagatggcttatagatagtcagtaagtatcttatcagcgtaattttataaactatatatgttgtaccttgttccctcatggctgcgacgatctggtttgccgccgtaaactgctcgtcctgcaatatccttttaagctccgggttcgtgatcttcccgatctcggccgatacctgcggacgtacataagtttccccctctttggcctggtaatcgaatttccggttaaaacattcctgtaccctgactttccagccctcatgtgaaaacccccgtttcaccgtccccctgccctccagttcccaggtgttcccggccgatttagcccccggagaaagtttcactttcccgtccaggctcttgcgtgaaacgattacgtgaacgtgtaagttcagaccgggtttaggctctccgatcctggcgatcccctgtttcacctcttcatcttccggatgataggatcgttccgtttccacacgtgcgtaatacatgagatcctggcctcccctaatattgtcccgtccgaagttcaaggcgtattcatccatagccgaacgggtgaacgcctccagcttttggaaaacctcttttttctcctgtggtgtaagttccttaaaatcgtccactttccggccgataaggtgcatttgttccgactgcgacggattgagcgaaagcatgaagaatttagcgtcgttagcccctaacgcctttttgttcccgtctatatccataattacccgttcgggtgaaatatcctgctccgtatgggagaaaaaacgctgtccctcccccgtttccttttccagataacgcaccaggtcgtgacagcttcccgtatttccgcttttcacgtcctcggccgggtgtactttggcaaacataggcttatctctttagttcgtcctttaaccttttcacccacatatccagcgtattacggtctatctcataaaccgtatcgttgaatgtcggtatcttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatcaagcctaaaccttgtactctcctttatacggatagacgtatctttacttgttgttgccataatttcacgtataggggtttgcatacataaatatcggctacaatatactataattcaatgaattatcaaaataatgtatgcaatatgtatgcaattcgcatacatataaacaagtaaacagttatatatcagtgatttggaaaatcagcattggactaagtccaatgactgcttgctcactttggtaaaccgtcgttctctctctccttgcttcgctcgtcgctcctggaacgctccgcacggcttcgctccaatacatcagacacccagcccccaaaatgcacattacaaatgtacaccgccccccaaaaaagtgtacatttgtaaaacggcggcaatcgttccgatcaccttatattttacaacacaaaaacaaaattttacacattttaacgcgcggaaaaatcgcactaaagaaacgcttcgctcattttttctccgtttctcattttccgttttcaaaatgcacattttccagccgtttttgaagcctgtgattccctaagattttccttctttgtgagaatagtctttgtagaggttctttgtaagaaagcgttttttcatttataattaactgaaatacaaatcgttataggtgaaaagacacaacctaaaatactcattttactaaaatccgaagggggaaaatacttattttactaaaattaccccctccaataaatacccattttactaaaggttacaataaaaagtacttggtattttttggcggtatcttttatttctttaactttgtcccgaactcaaaaaaaaaagcctatggcgaccaacgacatcaccctctatattcctcctacggaggaagaagtaatgttaatccagccgaataacgtaacattcggccagtactctgtgaccgagtggcaagaaaacctcctgacgctcataagcgaccagatccagcaacacatgaccagggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcgattacaaattcatctgcaaaacgcctaaaaaggggcaaaaaccgaaagccgacacgattatcctgttcatccatgcgagaaatccccaagaactgcgaggcgaccagcaacaacaatactcgttcgtttaccgttgggtttacggtgctttaagctatccgagcgacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaagatgctgcgtgaggatttcggtatcaaggccagggggaaaaagaaagatcccgacctgtttggttaaatccggaagattttctatatttgtgtgcggccggggtggttcccgtccgtctgggggctgacggctattgcacgtcaagccttaaaagtggggcgaattgacgtattacgacatccccactttttcatatacccctatattgtaatgcacattacaataatactaaaatactaagattagtatagacttatcttagtattttagtaaaacgagtatgcttgaaatctgcctccggcggggtttttactgggggcttctgacctttgcactgtttcctattgttccgtaaaatcagtgtcgcacagtccgcaccttaacaccagcccggattttccccacacgttacagccgcacccacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttcctgcccgtcccctctccaacggttggcggcgaaaaagccgaacgccccaccgtgacgggacatattcacgatacattccgaaagctcaccgttaaaaattgcgtcgttgtaaaactgatacaagtcgtccaacgtcttaaactggatcgtcgttatcataagccttttgtttttcaatctgaatgcaaagatacggatatttttgtaatgtacattataaaaatactaaaatactaatattagtataaccggatataaaagatacccattttactaaaatacttgaataagtacacgttacgtttacaaaatacactactgtaatgcgcattacaaaaatactatttttagtatttactaaaaaaagcgcatctatcccaaagattattcgagagatttttttatctttcggccgaagaatcccggaacggaaatattaaaaatatccacgttcccaataaaccatatacgcccatgtttccaaattacaaagactttcagatagctgtttactacacgctgggaaaagcacttcccaagcatatagaggaagtgcagacggagatcatcgagaatttcgatataaaatacaattcccccatgctcgcacacccgttactgcgtacccccatttacgagaaaatcatcctccgtatattagatacaatggaagatttaaaagagatccgcttttccgacgaccgtacccatgtcgtccttaccggaaggggtaaacatctcctggacgagtacgagaatgaaatgaatcagaggttgcctttcatcataagccgtaaaaagttcaaacgtcacacccaagaagagttagctaaggcataccgggaactcaatgaatatcccgattagtttttctcccaggattgagcgtacgaactaaaatactaaaagtagtatctactatttttagtagatgtagtatcaaacgaaacgtttctttaaggcgatgatcgggtttatcatcgtcttgtacatttccaggggttcacccataagctcgcaccggattaggtgtatcagcctctcgtctttcggatctgtcggctgcggctggcagtcctttcccgtcctggtctgatcctccagttcggccactaaaatatactggagcgtaaagatgtcggccacggtttccacctctccggccacctgtcggccatccgccgtaaaagcgaacacgtcgaaatcggtgttcttcaagttggtgttggtagtaggggtagccctcgtttccgccgcattacttaacacgttaaaaccaatcgcatttcgtgaggaggtttccacattcgcaatctcctcttctgagcaactcatcagtagtactccaaagattgcccaaagcattactgtactttttttcataaaatgaataaaattgttaataaatataattaataaaactcgattacaacactatatccacattcacatcatcccaatcatcaacgtccacatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgctgcctgaacggttcttgagatacagccggaaaacattgggctctccttcaagtgcggaatgtccaaacgtatagaatccgcctataatctgattccgtgaaaccattccatcaaagagcaggctctccgaaagagcggcgggcaaactgtcgccggacatgttaagcgagccggacatgccggaaagagcggcccgcaaatccgccaccctgtccagtccccgaattccgttcacctcatacgtgtagtgacataccatgtttacgggagttagccgtattatcttcgtgcttccttccggaatgtccttgaggataactctgtctatatggtcgccacacagccagggtggggtgacggccattgtctggttatccggcgaccgaacatcacgcgtatcggcagtaaaaagcgtgtaactgccgttttctttccaaaccatcccgtcggtatcgtagttgaagcaaattacccggtaatcattctcggggaactgacttaactgtccacctacgctccctttaaacccaataaatccggataacgctcggatcctccgtattaccgcggctgctggcacggagttagccgatccttattcatatggtacatacaaaaatccacacgtggatcactttattcccatataaaagaagtttacaacccatagggcagtcatccttcacgctacttggctggttcagactcccgtccattgaccaatattcctcactgctgcctcccgtaggagtttggaccgtgtctcagttccaatgtgggggaccttcctctcagaacccctatccatcgaaggtttggtgagccgttacctcaccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccatgcggttttattataccatcgggtattaatctttctttcgaaaggctatccccgagttatcggcaggttggatacgtgttactcacccgtgcgccggtcgccatcacttatattgctataagcatgatgcccctcgacttgcatgtgttaagcctgtagctagcgttcatcctgagccaggatcaaactcttcattgtaaaagtattgtttatcattcttatgaaagaatggtatttgctctgttcaggatgccgtacaatttattgacttcattaatacctgtcattcagatacatattgctatatatcgaacaagtattgacggttctattttttcttgtactacttgtattgtttatcaatatttcaaagaactaacgtgacttctgtcacgcagctttcttagcgaaagcggatgcaaagataaggactttttcagataacatccaaactttttcgaagttttttttgtttttattctctgaagccttattctctaacagaatgtcaattgttaggctctgtctctctagcaaagcgggtgcaaaagtagagaacttaatgacaatatccaaatatatactactcttttttcaaagtttttttgattaaaaatataacttcttccatattattgatatgataactatattacaatatacaaagccagttgtacgtaagtcgaacaactgacgcaagcgaggatgtatgtcttggcttgatccgagaattcgtcaaggaatttattgtctattatcattggaagaaatgtaaaatcgttaaaactctttctggaacaagtggcgggattgaacctcatactcaacgaagtactacctataaccttcttctttatacgtgatagtttcggtggaggcttctattcagtttcaagttaatggttggtaaagcccccagattatctacgatgagtgatattcctattacaaagttatttacatttatcaattgtatttttatttctaaatattttacaaacgttccttctgtcattttaatgagttataaatattaccaaaaatataaacacagcccaagccatgacaacagaagggacatcacatctaaatacaactaccacagaactgaggctataaaacttttctccataccatcttattaaccactcccacataagattgaatgatcttaacgactttcgttgaaacattctcgtcaacataacttggaactggtatgccgtggctaccatcctttgcgagctctaccgcaagttctacgctctgtaccagtcccttagtgtcaataccagagaggacaaagcacgctttgtccaaggcctcagggcgctcagtagaggtgcggatacagatggctggaaatggacgacctattgaagtaaagaagctactctcctctgggagggtgcctgagtcagatactaccgcaaaggcattcatctggaggcagttgtaatcatgaaagccgagaggttcatgcaggatcacacgatggtcaagtttgtaacctgatgcggcaagacggttgcgtgaacgtgggtgacaagagtagagaattggcatatcgtacttctcagccatagcattgatggcattgaagagagaaaggaaattcttctcggtatcaatattctcttcacggtgagcactcaacagaatatacttacctttttcaagtcccaaacgattgtgaacgtcagatgcctcaatttctgcaaggttctcgcggagtacctcggccattggagaaccagtaacgtaagtacgttctttagggagtccacagtcagccaggtatcggcgagcatgctcagagtaggccatgttgacatcagagatgatatctacgatgcgtcggttggtctcctctggaagacattcgtctttacaacggtttccagcttccatatgaaagataggaatgtgcaaacgtttagctccaataatactaagacacgaattagtatcgcctaacacaagcacaccatcaggctttgtctgcgcaaaaagtttataggaacagttgatgatattgccacaagtggctcccaaatcatcgcctacagcatccatatatacttcaggctttgccaacttcaaatctttaaagaatattccgttgaggttgtagtcgtaattctgaccagtatgggcaagaatcacatcaaaatactgacgacatttggtgataacagctgccaaacggataatctcgggacgagtacccactacgatgataagcttcaacttaccattatccttgaactttatatctgaataatctaatttgggttgtttttccatgatcattttttcactttatcaaagtatgtatccggtttatccgggttgaatatctcattgcagtacataaccgttaccaagtcttccgtatcggagagattgatgatgttatgggcatatccgggaagcatgataacagactgtattttgtcaccactcacctcgtagttcaacacttcgtctgtaccttccttgcggagttggatgagcccatgaccgctgacaacgataaattgttcccatttggtattgtgccaatgttcccccttagtaatacccggtttggagatatttatacttacctgaccacagttcaaggtatgtacaagttctgtaaatgaaccacgctgatctacattcatcttcagatcaaaaattgctttttctttgggcaaataactcagataagtactatacaatcttttggcaaacgaatctgacgggatttcaggaatcatcagcgtctttggcatttctgcaaactgatgcagcaaatcaactatttcgcctaatgtaaccttatgggtaaccggacaataacagtacctgccatccaccaatggatgtacgtcaagaccttcaaactcgcaatgatgttcctcgcctttcaaagcatgaatcatctcgtctacgagatcgtcaatataaagcagctccagtactacacttgaatcactgacttgtataggaaggtcgttagcgatattgttgcagaatgtagcaacagcactgttgtagttgggacgacaccatttgccataaagattcgggaaacgataaaccaataccttggctcctgtatccttaccgtattgtagaaaaagatcttcacctgcctttttgctgcgaccgtattcactgttaccgaaacgaccagtcagagaagcttgtgcactggaagagagcatgacaggacaagtattatgatgtttcttcagtgtatcaagcaatgtgcttgcaaaaccgaaattgcctttcataaactcgacattctctttgggacggttcactccagcaaggttaaacacaaagtcggctttctgacaccaggcatctaattgttcggaagtggaatcgatatcgtattcaaagacctcctcaatcttcagatcgccatagcaacgagcctttccgtttttgatattattaagttgagcacaaagatttctaccaacaaaacctttggcaccagtaactaaaatattcataactctactattgtacgaaattaccctcgccactcaattccttttgaatgtaatcaagagcggctattttaaccttggtctcttctacattcaatatataagtattattagaattgaactccgtaagtgtgttacgttccgtttcaccttctttgaagaacttatcataattcaagccacgattatcagcaggcacacgatagaaattacccatatcttcagccttggcacattcttcattggtaagcaatgtctcatacatcttctcaccatgacggataccgataaccttgatgtcttctttcttgccaccaaataattcacaaacagcctctgcctgagtctggatggtacaagccggagctttttgaacaaggatatcaccattctgcccatgttcaaaagcaaagagcacaaggtctaccgcctcttccaacgacatgataaagcgggtcatcgtaggctcagtcaaagttacaggattgccattgcgaatttgctctatccacagaggaattacagaaccacgagaacacatcacattgccataacgcgtacagcaaatcttggtcttaccagagtagcggctcttagctactgcaatcttctcctcaacagctttcgtgatacccatagcattgataggataggcagccttatccgtagatagacatatcacagcaccaacgccagcctcgatagcagccgtcaaaacgttatctgtaccgattacattggttttcactgcttccatggggaagaactcacaacttggaacctgcttcaaagccgcagcgtgaaagatatagtcaactccaggcattgcgttcttacatgactgcaaattacgtacatcgccaataaagaacttgattttgtgtgccacatcaggatactttacctgatattcgtgacgcatatcatcctgcttcttctcatctcgtgaaaaaatacggatttctccgatgtcggtacgaaggaaacgattcaaaactgcattgccgaaggaacctgttccaccagtaatcataagggttttacctgcaaaaatactcataatgattttatctttttatttttatataatcaacctatggatggtatttgaatgtgccataatacttagcataccaccctgcaaacttcctcaatccctcacgtaatgatgttgacggtttaaatccaaaatcttgctgcaaaggagtagtatcagcatatgtcacaggcacatctccaggttgcatcggtactagttctttgtaggattcaaagtcatagtagttgggaagtacacctgcacggataagttcatcctgaaggatagtaacgaaatcaagaagattttcaggtgagttattcccaatgttatataccttatacggtggcaccggaagtccatcctcaccattccgtttctccggtgcatgctgcataatacgaactatgccttctacaatatcgtctatataagtaaagtcgcgcttacaattgccgtaattataaatttgtatggtctcaccctttaatagcttgttggtaaagctaaaataagccatatcaggacgaccgcagggaccgtaaacggtgaagaatcgcagacctgtgcttggtatgttatagagcttgctataagcatgagccattaactcattgctctttttagtagcagcgtaaagtgatactggattatctaccttatcatcggtactataaggcactttcttattgcacccatacacactactggaagaagcatatactaaatgctccacgctatgatgacgacaggactctaagatgttataaaatccaataagattactttcaatataggcatcagggttagtgatgctatagcgtacaccggcttgtgcagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcaataccgatgactttcacggtatcaaactcattcagcaaacgttttaccaaattggctccaataaaaccggctgcacccgtcactagaaccactttgttctctaaactaacattgtatgttaccataaagttaatctctttggaaaatgtcacgagtatataccttctctttcacatcatccagacaagcatcgtaacggttggcaattatggcctgacttatttccttaaactcgaccagattattgatcacttgacttccaaagaaagtttcaccatcttgcatagtgggctcgaaaatcacaatagtagccccctttgccttgatacgcttcataatcccttgaatggcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtataataacccgctttacgcagcacttgatctgctatgaagtcttttcttgtacggttactttcgacaatagcagtcatcatgttctgaggtacatcctgataattagccaagagttgtttcgtgtctttaggcaaacaataaccgccataaccaaaggatggattattataatgtgtgccaatacgaggatccagaccaacaccttgtatgattgattgagaatccaaacctttcatctctgcataagtatcaagttcattaaaataactgacacgtaaagcaaggtaggtattagcaaacagtttaacagcctccgcctcctttatacccataaaaagagtgggaatatctttcttgattgcaccttcctgaagcaatgcggcgaaagcatgtgcagctttctctagagtgagaacatcagcaatggccttaatagcttcgttttcctcgtcaaactgctcaccatcaattagttttggatatccaacaatgatacgacttggatataagttatcataaagggccatactctcacgaagaaactccggagaaaaaagcaaattaagcttcttaacttcctttcgggcatacttcaaataaagtccacggcaatatcccacaggaatagtagactttattaccatcacagcatcaggattgacacttaaaacaagatcaatgacatcctctatatgatgggtatcaaaatagttcttcacaggatcatagttagtaggagccgctataatcacaaaatcagcgtcactgtaggccttggcgccgtcaagcgtagcggttaggttcaatgccttttcggacaaatatttctctatatactcatcctgaataggcgattgtttacggttaagcatatctactttctcaggaatcacatcgactgccgtcacctgatgatgttgcgacaaaagcgttgctatgctaagaccaacatagccggtacctgcaacagcaatcttcaattcttttgtatccattgttgatttatgttagtgttcagaattattctagttatctatccaagacctcaaatctcggtgagttctttgatttaaactctggtaccactctcttcattagtttcactgtgtccatgatctgcacagaacgagatagcttctcaaattctgtataagtatcaaggatatctgtatattcataatgacgtaccttcgctatcattatcttcttattctcagtagggattgtgttctctttatcactcaggacttcttcataaagcttctcacccggacgaagtcccgtaaactctatctcaatatcctcacccggacgataaccggccaattcgatcatacgggtggccagatcaacaatcttcacagcctttcccatctcaaagacaaaaatctcattgccttcacccatagtggcagcctccattaccagacgacaagcttcggggatagtcataaagaaacgaatgatatcggggtgagtcactgtgacaggaccgccattctcaatctgttccttaaaacggggaattacagaaccgttactacccaagacgttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtttcgagcatcccatgacattggtcggattcaccgccttatcggtagaaaccatgatcatcttctcagctccgtattcaactgccatatcggcaacctggcgagagccgacaacgttgaccagcacagcttcacagggattctcttccattaacggaacatgcttataagcagcggcatgaaagatgatctgaggctgataagtttcgaagaccatacggagacgttctttcacgcggacgtctccaatgacaggaacaaaatcaagatcgggataattcttctcaaattccaggcggacattatgcaaaggtgactcggcggaatcaaacatgatcagcttcttgatgttcatctgagccagttgccggcaaagctcgctgccaatactaccggcagctcctgtcaccagcacaaccttgccacagaactcagtcatcacctcctccatattgatatgaatttctgagcgacccagcaagtcttcaattttgatagggcgtacccattggtggaaactgccgttttcgtcagcctcactgatactcggagcaatcaacgttttcaatccactccttttacaatactgaagcaggcggtcttcctcttcacgggtattctcgtaacgggcaaacaggatgccgccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttatgaataagcttgttaaagcactcttcatccttaaatgaataaacgggaagatcagccacgcgtcggatggagtcgcccgttccgtagatacagaagcctaccactttatagtgggagctgttcattagccggactttcaatgccacactcttatcatcaataccatagatcagaatatgcatattcttcttattcagcatattcagcaggagttcataaaccagaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgaatacggaagcctaccatggcaataaaagtaagcataccatcaaacagtacaaagactattttctgactattatgcagtcccgtctgaggcaagaaaagccagatagccattgcgatacagacagcttttatcagcgcacttccggcaagtctccataattccttcaactgggaaaagcggatcgtattacggtaggtatggaataaaaaggaacctaagatactggaaatcacagaaatcgccaaaatatgaaagagagaagtgatttctttagaagtctccgttatataatgaatgccgataaatgacacccaggtacaaatcaaagctatgaatgtatcaattcctaatacaatccaataactaaaatagtttttctgcaaatattgaacaaaacggtcaaatgcgtgtttcataatttaaataccccaataaattataaagtcttttttcaaaaaaagtagatttactatgacaatagtttatcgtagattgtgtgtaactgaattttcaatggtgaaggcaattggtttttcagaatcatttgcgaacgcctcagaacagtcttcttctttgcctcatcctctgaattggcatacatagacacactatatcccatcagaagagacagacacaaagcagcttcctgctcagcagtcttaccgtgataaggatacagatcattgatctgttcatggatctctttattaagtagtgaaagatcgtcgacacatatacagtccatattctcacccatatgaagcaatgtatcaactgttttttgtagtttttctattttctcctgtatgctattattgaaggtccccatcacctcttagtttctttcgccaatttgctctacatatccgataggcatatcgacacaagcgcagcccaacatatccagccggacagcaatcttacttttgccatctaacgcaactagttctccaaccagtcccgtcaaaggacctttgataacacgaactttctttccacgagctaatggagaataattcatacagattgcctcttccgaataatcgagcataaaacgaaaactcgccatctgatcatcaggaatcacagcaggctttccctcaccacgcaacaccatgtaacggcttaccgtggcaagagttaaagcagccatccgttccttcggatcggcatgaacaaacaccatcatcggaagaagaactgtttcaactaatttacggcgatcactccattgatggatttcttgctggacaggaacaaaagtctcaattcccattttccccaaatattcggctacttttttttcgtgatgtatgcgaacatgtgccacataccagcgttttaagcacgctacgccctcccctgtcccatttttggtcccgaggatggctgatttctcttttgttagaatcatgtttttttaccccatatgtttccgttacttcttaggtaacggaagtgtataaagcataaacgaacaatgaaaaaaggttgaaaagcagcagcaaatatgttgtcaagagagttacaccctaagtagaagggtatataccaatggaaattaggtatataaggagtggggcatgaaaataagtatttttcatgtctaaagatgtttttaccctatattttagataaaactaaaaaaagtgggctttaatttgtttcttatttgtgtttttgtctatctttgcatcaaatttacttccgttacctaagaagtaacagaaacagatccatactgactatcaacttattaaatattttacacccgtcctatccgacagttcttcacgtaagataaattcattcgattcacttctgtacgttcctgcagaccaaaacctttcagataaatctgagtagtcttaatagacttatgccccagcgactcactgatcatctcaataggaacaccacgatacttagcggtagtagcccaggaatgacggatagtataggaagtgacgggagaagtcagccgaagagcctttgcaagtctcttcagacgattattgaacctgcggagagcggactgatattcccggtatgcactttcatcttctctcttcttgtcgccaagaaggatactgaacagatagtcgggacaatccggatgagaaggctgacagttgcgaagccggctgattatatcctgtgcagtatccagtacttccacactcatcggagttttcgtcttgatacgattataccggatgatattccgttccagcgaagatttctccaaatgagcaaggtcagcgaaagacattccgcagaattgaaacatcaaggcagcgatagcctgcgtacgacgcaaacgttccgatttgggatcttcatagaggaggcgattaagttctccgacaggcaacgctttcttctggcaaatatccactcccgtataaacatcatgaaacagacgatgcacatacggagctctgcccgactccactcctctattatagatgctacgaagcatacgcatatacgttgataccgtattcggcttcagaccggaactataaagatactgcccgtaacagcgcaagcgttcacgggtgacttgccggaaagcaacatgggtagtgccacaaaacttggtaaaagaaaaaagagcattcgtataaacatgggccgtagaatgacgcccctcttttcgtaaacgaccgatgtacgactccgcacaacggctaaatccatttttattcatatatatcactagtaaatttatacaatgataagacgaaaaaaatgatttagcaacagaagtttaaaacctttccaaaaaaattatataaaactgaatggggatagaattgatgctactccactatccacttctcaatattgcgtgtttctgagctaaaattgacacctatcttgaaaagtcggcgtccgtctgcctcaaaaggaagtgcataatgcttttcattaatctgtttgatagcttcttcagcagtaccatccaacttaaattccatcacatatatgaatttgtcagtctgtaagacaagatcgatacgcccttcacttgtatgatattctaccttaacgtagaagccaatcaacttgaagacaatgaatagtacattctgataatgcaactccaaatcacgggccaactcatagggagtatcggcaaagaagctttgcaggcgatgaaagaaagcatcacaatcgccttgttcgacttcatgaataaatttagtgatctgaaacggtgaatctatctgatctacatttgcataaaatggaagcaaatatttcataaatccttcctctacttcacgattgggaaaacctaaacgataaattttaaaacgacggtcataaccttttatcgtaagatatccactttgataaatcaccggaataggattttttgaagtggaatcaatactattcaaaacatcggaatctgtttccacatttacaacacgccggagatcgtaatgactactttttaaaagttcaaccaaataggtcggtgtacctgtttcaaaccagtaatcaccaaacttcatttggtcaaatgtattaagcaaactgaagggattgtaaataccgacagagtcttctacaaaatggtagccatcataacatgctttcaattccttgcaaacttcatcataactcattttctgattccgagccagttcatgaagttctttttccagattatcgtggatttctttctccgtaatgccgcaaatttcaataaaccgttcatccattgatatatctttcagattattcaagtcactgaaaatacttactttaccgaacttagtgacacctgtcagcatagcgaatttgatgtagccatctttgcttttcaatgcaccataaaatggcttcaatgtattacggtagtacttttgcaattcatcgtcaccaatggcttgcaacatgggtttgtcatactcgtccaccaagatgacaacgcgctgtcctgtcttctcgcaggcacgctgtataatacccgcaaaacgcagggaaaacgaacgctcggagggttcggctccatatagtttctcccatgctaccaatgacttttcgagtatgttatcaagactctcgggtacatcatatttttcgatattgaggtccagatgcaatatcggatgctttatccaatccttttcaagggtctcgatagccagaccttcgaaaagttctttcttcccctgaaagtaagcttccagcgtagatataagcaaactttttccaaagcgacgagggcgacttagaaaataatatctccctgttcttgctaattgataaaccaatgccgttttatcaatataaaaataatcatccttacggagactctcgaagttttgtacaccaatcggataaatcttgctattcatactttctctgattatttattcatgtacccaattaggaatataatcgggcatgcacaaagatacacctttctttctacaacgcaaagcaggcgagaaagtttttctcgcctgcccggtctatacttttatcaataatattgtctattatttacacgtatgtttccagcaattttacgtttccagcttccggagtaattgttacatcctgtgttgtagcaggaagcagaatagattctccggcacctactttcagttcattaccttcattgtcttttatcttgcatgcaccttccatacaaatgaagatcacgaatgaatcgagttctgaataatcacagctgatttcttcggtcatatcatacacggaagtagtgaagtacggacaagctacaagttctaccggctcatctttcaccgcttcgtatttggtacgataatcatccaacacttcgtaattgatggcttcacgcgccaggtcagtatgcaattcacgagtctttccgtttgcatccttacggttgaagtcatagatacgataagtaatatccgaagtctgctggatttcggcaataaacgcaccggcgccaatactgtgcacacgtccggcaggaaggaagaatacatctcccggcttgatctcatactcctgcaatacgtcagtgatcgtattgttcagcacgcgctctttatattctttcggggtgatttgctcggaaaatccagaacgcagtttcgctcctttatcagcatccactacataccacatttcggttttacccattgagttgtgccttttctttgccaaatcatctgccggatgcacctgaatggataaatcctgctttgcatcgatgaatttgataagcagtgggaatttattgccaaaacgagcataattcgcttcgccaaccagttcctcgcgatactttctcaccatatcagccagagttaaacctttgtccgggccattagccacaacagattcattgtcctctacgccggaaatctcccagctttctcctactcctttcaagtctgaattcaaatgcttgaacggaataattttgtcgcccccccaaagcgtctgcttcagaataggttcgaattttaatggatacatttttgtttttcttgttaataaacttagattaaattctcccggattataataatccgggaacaaacatacgaaaaattgttcactttaaaagaaaagaaggatgaaaaatacagaaacctaagtgagaacgctaaactttcctaaactacccaccatatttagccggaataatttgtgagtaacaaagaatttacctttatttgcaagaaaattttaagaataccagacatgaataacacattcccaacggaagggaatctatcagggctcagccggaaagatttccaaaaggagataaataataaagaaactgatttatttatcctcaaaaataaaaagggaatggaagtcgccgtaactaattacggatgcgccattctcgctatcatggtaccggataaagatggaaaatatgcaaacgttgtcctcggacacgacagcatagaccacgttgtcaacagcccggaacccttcctcagcactactatcggacgctatggcaaccgcatcgccaaaggaaaattcacattgtacggagaagagcacgagctcaccatcaacaacggacccaactccctgcacggaggacctaccggttttcacgcccgcgtttgggatgccgaccaactggctgaaaatataatccagttcaattatgtttcagccgacggcgaagaaggtttccccggcaatctggaggttgaaatggtttatcgcctggaagaagaagaaaatgcactggtaatcgaatatcgtgccacaactgacaaagctactgtagtcaacctgaccaatcacggtttcttcaatctggctggtatcagcaatcctactcctactatcgaaaacaatattgttactatcaacgctaatttctacacgcctatcgatgaagtttctatcccaaccggagaagttgccaaagtagaaggtactccaatggacttcaccactccgcataccgtaggcgaacgtatcaacgataaattccaacaactgattaacggtgccggatacgaccactgctacgtactgaacaagattgaaacaggttcactggatttggcagctacttgtttcgaaccgaatagcggtcgtaccatggaagtatacacaactgaagcaggtgtacaactttacaccggtaactggctgaatggtttcgaaggtgctcacggtgctacattccctgcaagaagcgctatctgcttcgaggcacaatgtttccccgacactccgaacaaacctcatttcccctcggctactttattgccgggcgatgaataccagcaggtgactatctacaaattcggtgtggaaaaataaaagataaaaaataactaacctaattttataaactaacatttttaatagaaccatgacacaagaaaaaaagaatggaaaaatcattgccattatcacgatgattttccttttcggtatgatttcattcgttactaacctcgcagctcctatgggtattgtgctgaagaaccaattcgacgtatccaatgctttgggtatgctgggaaacttcggtaactttatagcttatgcagtaatgggtatccccagcggtatcttgttgcaacgtgtgggatataagaaaacagcacttatcgcagtagctatcggttttatcggcgtaggtatccagttcctgtccggtcattcaagccctgagatggcttttgccgtttatttgattggtgcattcgtagcaggtttctctatgtgtttgcttaacactgtagtaaacccgatgttgaacaaactgggtggtgaaggtaacaaaggtaaccagcttatccaggtgggcggctctttcaactctgtaatggctaccatcactccgatgttcgttggtatcctgatcgccggatctatcgaaaaagctactatctctcagattttccctgtaatgtacaccgcaatggctgtattcgctttcgcattcttcgtactcctgtttgtacgcattccggaaccgaacgctgctgctacaactgaaccaatcagcacactgatgaaaggtgctttgaagttccgtcactttgtattgggcgctatcgctatctttgtatatgtaggtattgaagtaggtgtaccgggtactctgaacctgttccttactgaccctgtagaaaaaggcggtgccggtatcgcttctacaatctccggtttcgtagtaggaacttactggttcctgatgttgatcggtcgtctggccggtgcttcactcggtgcaaaagtttccagtaaagcgatgcttacatttacatccgctctgggattgattttagtattccttgctatcttctcttctacaggaacattggtgaatctgcctgtactacaacaaagcgcaactggcggtttgtcattcggttttgcagaagtgcccattaacgctatgtatttggtattagttggtctctgtacttctatcatgtggggtggtatcttcaaccttgctgtagaaggactgggtaaatatctggctgctgcttccggtctgtttatggtactggtatgcggtggaggtatcctgcctgtaattcaaggatgggtagctgacgtagccggtttcatggctagctattgggtaattatcgctgctctggcttacttgctgtactacggtctggtaggttgcaagaacgtaaataaagacattccagtagaataaaaaatctgaatttaatttattcaccttataaaattgatttatcatggatatagaacacgtaagaagtcgcttcattaagcattttgatggaactacaggatttatatatgcctctccgggtcgtatcaacctgattggcgaacatactgactacaacggtggattcgtattccccggagctgtagacaaaggtatgcttgctgaaatcaaaccgaacggcactgacaaagtaagagcttattctatcgacctgaaagattatgtagaatttggtctgaacgaagaggatgctccccgtgcaagctgggcaagatacattttcggtgtatgccgtgaaatgatcaaacgtggcgtagacgtgaaaggattcaataccgctttctccggcgatgtgcctctgggtgcaggtatgtcttcttctgctgctctggaaagtacatatgctttcgcattgaatgaactgttcggtgaaggtaaaatcgacaaatttgaattggctaaagtaggtcaggctactgaacacaactactgcggtgtaaactgcggtatcatggaccagttcgcttctgtattcggtaaagctggcagcttgatccgtctggactgccgttcactggaatatcaatatttcccattccatccggaaggttatcgtctggtattgatggattcagtagtgaaacacgaactggcttcttctgcttacaacaagcgtcgtcagagctgtgaggctgctgttgctgctatccagaaaaaacatccgcatgtagaattcctgcgtgactgtacaatggatatgctggaagaagcgaaagctgatatcaacgctgaagattatatgcgtgccgaatatgtaatcgaagaaatccaacgcgtacttgatgtttgcgatgcgctggaaaaagacgattacgaaacagtaggtcagaagatgtacgaaactcaccacggtatgagcaaattgtacgaagtgagctgcgaagaacttgacttcctgaacgattgcgctaaagaatatggtgtaaccggttcacgcgtaatgggtggcggcttcggtggttgtactatcaaccttgtcaagaacgaactgtatgacaacttcgttgaaaagacaaaagaagctttcaaagctaaattcggcagaagcccgaaagtatatgatgtagtaatcggtgacggttcacgcaaagtagaataagttattattcatcagaattaaataagcagggcgtctttccggaatggaaggacgcccttacttttcaattaacaaaaatctaaaaacctattatctaacctaaccctataatttcctgtttattgtacgccttccgttgtcatctgaatgcgtttcatggtaccgtcctcgttataatacaaacgatcgatgcagacggaacggcggaaactgcctccggctgtattgatgcttccattatgataaatgaaataccagtcgcccttgaactcgataatagcctgatgattggtattggaattgccggctatctcattaaggatgcctttgtattcccaaggtccggtaatgctacggctcatggcgtagcatatcttttccggaaattcagaagcatatgaaaggtaataccagtctccacacttatgtatccacggagcttccgtatatcggggcagatgaaccggtacgataggaccatccagctcgatcatattctttttcagtttgacatagtagcattgggtattcccccaataaagatatgcctgtccgtcgtcgtcaataaaaacagtcggatcgatatcttcccaagagatcttggtaaattcggtcgtcatatcattggtgatcagtgcggaaccacgggcatccacaaaaggaccgacaggcgaatcagatacggctacgccgatagattttccgtgaatagtgccgtgttctactgtcacataccaatagaacttcccgtcacgttctatcacctgactagcccatgcttccccttttgcccaactaaaatctttggctttcaaaggtacaggatgctccgtccatgtcttcatatcgggagacgagaatacacaccattcattcaactggtaatgttctctgggaggaggacattcatcatgtccggcataaatgtacaccttaccgtcatgcaccatagcacccggatcggctgtatatttatattttatgatgggattgccatcggctacaaaagtagtgtcattctgcgcagacagcccggaaaaggctgccaatgcacatgaaatcataactagtttaacgctattcattttattttttcgtgaatttataaactgcaaacgtgttcggtccgagttcggtggttaacgcatgaccattgatcgttaccggtgtctcctgcggagtgatggcaaacggttgttcaagcgtattatctttgtcctgatcgagtgagctaagagtgatgcaacgtccttcggacaatacatcctgctttttcagaccttcgaaagtcaaggatacaggctgtgtcttatcggaagtattagctactttgacaatcagttcgttcttatccttatcatagactgcactggcaaaaagtccgttttgtccttccgcccctgttaccggtttcttgttcatagtgagaggaagtacattcgttcctttgttctgtgcgtacagctgctgcacataataacttacggtacgcaccgagttaagattatcaaaccaaatcatgtccggacgccattgccatccctccacatgagcgaaaagcggcgcataagtagccatatgtacgatatcggcattacgttccaatccggtcatgaaggctgcttcgagcaaggcagcatggaagtggttccatttctttccttttccgtgacaagcatattcgccggcaaatactttcggtcctttgcggtcatagttatcatagcgtgctccctgactgaggaaccagctttcgggacggtagaagtgttcgtctaccagatcagctttcagacgtttcatctcaggccacaggtaatcgaattcttttccttcggagttcgggccggaactgcctacaatcatgatttccggatgcgccttgcgaagagccttgataaacggttcgagacgttcgggatactcttttccccactgttcattaccgatgcccagatatttcaaattgaaaggtgccggatgtcccatatcggcacgtactttcccccaagtcgtgttcacgtctccattggcaaattcgatcagatcgagtgcatcctgaatatagctgtccaggtcgcaaactgctacgtgagctttttcttcattgttctgatactgacaggcaagtccgcagttcaggatcggaagcggtgccgctcccatttcttcagaaagaaggaaatattcatagaatcccagtccgtagctttgataataatccggatagaaacgatgggtaaaggtatattgccaacgattttcgttcaatggacggttttctaccggccccacggatttcttccagtcataacgggtttcgagatccgtaccttcaacgatgcaaccaccggggaaacggaagactcccggatgaatatccgccaaagcctgcgcaaggtctttgcgaagaccgttctcatgtcccttccaagtatcgacagggaaaagggaaatatgctccaagtctaccgtaccctgggaagcaaggaaaatacgaagcgttgctttgggattggtaacacccgcttttaagattacctgatacttcttccagtctttggaatcaatggtcagtgtctgagaggcaaaagcctgatgttcgcccatagatttggtatctacaagttccacacgtatcttttcacctgtacctccgtgcggcagacgtgcccacacagagaagcggtattcttcaccttgcttaaccccgatgccgaagaagccttcattatccagtccggtatgcttgtgggcatgtcccggattatcaagacgcacataatgcggattgcgttcaaaaggaccgtcatcctgcaaagtcacctttccataagtcttccatcccatcagacgctgagggaattcgaatgaacggttctttaccagttcggcataaagtccgccatcggcagcataattgatgtcttcaaaaaagagtccgtacattgtcggctggatttcagcacccaacttcttagtctggatcaccatttcattggtttgcgcatgaagcgccatgccggtagataaggctaatgcagccagtaattctgtgtatcttctcatggttttcaataaaaattatatatagttatttgattctttttccccagacagaacgtccccggctatcgagtccggtaaagagaattgtttcggtttcgttctcccaatcgtgtcctgcaaagataaccagattctcaatcttctccgagttcaaatctaccattaatagatgtttttcggtcaaaaaggaccattttccattcatttgaactatattccattcgttatcggtcatctgccctttgcacgtgccgtcttttaccaaagtcactcgggtggacaagttccattccttctctttcagttctccctctccccataagatctgtccggcttccagctgacgttcgtatgccggttcctgcactcgtatgatttcccattcaccgaccagatcttctttgctgaattgacgcgaagcagtccctgcatatctctcgggagaagcgaccggccagccttcgggagtgaagaacaactgccgtatatgtaacaccattaactgattttgcggtgacagacgtccctgatgtgccataaaatagtttccttcaccgtcagaaaagacggcacaatgcgctgtacccgcccatccggtatggttctcaaaacgatatggtgcagtcagtatcgggaagttgttggtcgtatctttcacagccttgccaaagtagtccgtaaacggaccttcggcagcatccgaacggctgacacgtacattataagtcgtcatcagcggatcataggaagtgaaaagataatattgtttcagctccggatgatagattatttccggtgcttcgagattgtccttccgatagttggcacgccgtgctacaaggtgccccaaatcgccttcgtttaaggctaatccggtttcaggattcagttcgacgcaatacagaccaccgaagaaggagccgtaatgcatccaccatttaccagtattttcatctgctatgacgctcggatcgatagcattcatcgcggtagaatcatctgttttaacgatacagcctttctgcgtccatggcccttcgggagaagttgattcggcaagtcctatataggatgttttacgtccgaatgcggatacgcaatagtagaggcggtatttatctttataagggatgatatacggtgcccagatattggtcgccccctgccctcctgcatgagactgtacccattgaaccgcttcttccggtatttcaggaaatgcccatcccagaaattcccaatgtaccaaatccttagaacggcgcatctggataaatcccaacggcacgcctttctctctcgcttctttccggttctcaccgaaaatcgcatctgtagaatacatataataatagtcgcccagcttccggcaggacggatcgtgtacattgtatgttccccattgacggtaatcttccattttggctactgataaataattatcatcccaagaattagcagaaggagtcggagtaaacacggaagaagtgcaacttacaaagaagctgcctgctactaaaagaactggcaaaaacaagtttttcataatatctgtgtattcgttcatcaattatgctacaaaaatacgccccgtttcccctatgaaaggtggacatacgaacacgattggtggacaatccgataatctgctgaaaagaagctcttcccatttttgtgattgaagagattcttctaactttgcccttattaatacgtacatatatgaaaaaacacctacttatataccttataatatatagtatctgttcactggccggacaggttcgggcacaggaacggtttgccgaccgctataatattacgtatgtgaccatgaacgaggggcttccacataattttatcgacgatttgtacaaagacagccgggggtttatgtggatttcgactgccggaggcgggctttcccgttatgatggctatgagtttgtaaactacactcccaataatcaccaatgcaaactaaaaagcaactttatacgcaatgtctgtgaagacgccttccaacgcctttggatcgtctccgaagggggaacggatattattgacttatctactttaaaaccgattatcccccatgacccgaaagggatacttccaaagatactggaactaccggctacccgtatcatgaaagatacgcaaggctgtatctggcttcattgcgacaacgcccttcaccgtatcgaattcaatgacaaaggggaagtgcaaatcctgtctacactcagccctgtctatctgaatggtccggacattgctctgaaagacattgacgaggatgggaaaatatggatgggaaacaatggagaaatacgaaaagtggcattaagtccgcaaaagagactggtaaccactcccatagccgactgcctgaagttcgaagcgggaacttatatttcggatttcctcagcaaagagaatgaagtctggatctccagtgaccgcggactattccgctataataaaactggaaatgtgataaaacgatatgagcatgattccggcaatccctattccctgtcgcaaaattatctgacaaatttagctatcaccgatgacaaacaattaatcgtcgcgacactacgtggtattaatatctataacccgatgacggataattttgaacgtatagcctgtgaccttccaaatggcggcaccaatctgctgaacagtaactttattaattgcatattgactgatggagaacatatctggttcggtacggaaaccggaggtatcaatctgttgaatccacggcaactatcgatacggagctaccggcatgacaaggaaaatccgtcaagtttatcctataatcctgtcaatgcaatttatgaagatgtatacggaaccttatgggtagggacagtagaaggcggactgaacagaaaagaacggaacagcgaagatttcacccattatacacgtgaacacggagggctgagtcacaactccgtcagtgccctgactgccgataccgacaatcacttatggataggtacatggggaggaggtctcaatctgcttgatctgaaagctccccgacagatactggaggtaatttcctcacagaccggcggaggctttccgattaactttatcggagtattgaattatgaccctattaatgaaggtatatggataggcgccaatcaaggactctatttttatgatccggtaaaaaaggaaataactgctccgttaccggataaggctgctgaaaatattcatggctgtatcggttccattattgataaggagggtaaactttgggtcggttgtctggaaggggtttatatcatcgatctgcattcccgttcctctaaaggagaattccagtacaggcacctgaactacaaactggacgatccgtcctcccgcctgattgagaaaataacctgcttttatcaaggtaaggacggtactttatggctgggcagtaacggatatggcatttatcaacgaaaaatcgatgctcaaggaaaagaacagtttatctcttatagcacagcgcaaggactaccgaacaatagtgttcggggaatactggaagataacaacggtaacttatggatcagtaccaataatggactctcctgttatcatcaggcagagaatcgtttcattaactataccatacaggatggtctgattgacacacagttttattggaacgcctcatgcggttcttctcatgacttactctatttcggcagtgtaggcggattggttgcaatcgaaagtaatcgtccggcgatgtctcttccagctgccaaagtacgtttcacccgcctgcggataggtaatgaagaaatattgccgggcagcgaatacttgtcggaagatattgccataacgacggaactgaaactgcatgaaaaagagaaatctttctcactcgaatttgcagcgctcaactttgaatcaaacaatacagccatatacagttatcgtctggtcggttttgacgataaatgggtacaggttccgggcaaccgtcgtttcgccagttatacgaatttacctcccggttcatatactctacaggtcagatacactcctgatggtgagaacgagggagaaaacataacggaactgaagattacgattgtaccttatttctataagactgtatggtttattctattcatcatcgtattgttatctgtcagtgtatggcaattctatcaatggcgcatccgtaatctgaaacggcagaaagaatatctgcaccgcacggtagaagaacgtactcatgaactggaacagcaaaagcatctgttagaaaatcaaacggatgagctgtcacgccaaaaccagatgctgattcagcagaatgagaaaatcacgaggcagaaggcacaactgattcgtatgtcccgtaaagtgcaggaattgacgcttgacaagatttcattctttacgaatattacccatgaattccgcactccgattactctcattatcggtcctatcgaacgtgcgttgaaattaagctacaatccgcaagtcattgagcaattgaacttcgtggaacgcaattccaaatatctattgtctctcgtcaatcagttgatggatttccggaaggtagagtccggcaaactggagattgtgaagactcggggaaattttctgaaatttatcgattcactgatcactccgtttgaagtattcgcccaagagcggaacattgtgctcaaacgctattaccggatggaaatgccggagatcttgtacgatgaggaagcaatgcgtaaggtggtcaccaatctgttgagtaacgctatcaagtttactcctaacgggggaactgtgtctctctacctatctgctcttttcgccaaagacagtgaaaaagagactctgtatatttgcgtcaaggacagtggttcgggcatccctgaggaagacctcaatcggattttcaaccgcttctaccagtcgcagaatcaagtgaaatatccggtatacggacaagcaggaacaggcatcggtttatacctctgcaaacggattgttcaaatgcacggcggagagatcaaagcattcaataaccgtcatgcgggatgctctttccgcatcctcctccccttgcaacgaaatgaaaggaaagacgaaaagacaatcattattgatcacaacgattcgtccgcaactcctgttcaggattccggctctccaaaagagaaagaggctttaagcatactggttgtggaggataatgctgatatgcggggatatatccggtctattcttcgtgaacagtatcatgtactggaagctgccaatggcgaagaagcattacatatacttaatagtaatccaatagactttattatcagtgatttgatgatgcccgtcatggacggaatcgagctgtcccgaagggtaaaggagacatttgccatttcgcatattcctttcctgatgctgaccgccaaaacctcacaagaagcccgactggaaagctatcgtatgggagtggacgaatatctgctgaaaccttttgatgaaacattattattggcccgtattcagaatattctggagaaccggaaacgatatcaacgtaaatttacgcttgatatggacgtggacgtacttaatatggaagaagaatccggtgataagaagttcctcaatcaagtaatggaagttatcaaagagaactacaagaactcctattttgaagtcagcgatttttgtgaagccgtcggagtaagcaaaagcctgctgaacaaaaaactgcaaaacttaatcggtcagtccgccggacagttcatccggaattacagactgaacatcgcacgggaattgattctgaagaatcgggaaacgaagaatatgaatatagcggaagttgcctacgaagtaggattcaatgatcccaaatattttacaagatgcttcacgaaacatttcaatgtgacaccaagcgcactgctgaataacgaagaataactgatataagggttgctattatgaaacaatgatagcagcccttcgtcttaaaatgagctcattttaagagacatccgtccaagattatactcaaagtgtaaaaaagacacttatataaccgtttatccacctcgaaaattcatttgtccacctttaatatactcatcggttgtatttttgcgacactacaacgagtagaattattgttgaaccattaatatcaatatctatgaagacaaggaaatggccgttactacttatggcaattcttaccgttctcagcatgagttcttgtcaggattggggagaagccgatccaccggcaggaaatcaaaaacttccagcaaagccggatacctccgctaaattaatagctgaatttacatttgacgaagatttcaactctactgccaccgaaggcaaaacacctatatcgggggaaggttttgcatacagtgcagatcaagagattccggaaatcgtacaagatgatgaaagagaaagtggagttatgcacgccaacggcggatacctccgcattcccaaccctcttatcggtgcagatatccagacaggagtctcatttagtttcttcgtaaaatctactaaaacagaccatacaggcgcactgatctcattcagtgacggaacaaacaaactgtatttcactgcaaatgcttttttgagctataccggcacaggaggctatctggacgtaaatgatccggaagtcagtgtaacgaacgcaatgccttacgggacatggcattatgttgccttgactttcacagagaaaggatacgccatttatatcgatggcaccaagaaatacgataccaacaaccatgccagcatcagttccggaaagacaagggctgtgagcgtaggtgacttcgattattccaatatgatcgatttattgtcatctgcgacctatatatatttaggctatggttcggatacggaaacagccgaagcctattatgatgatctgaagatctggacaaatactttctcggacagcgatgctcagggaccgaatatcggtagcggaatacatgtgcccgatcctgtttataaagctactttcgaaacgactaccggactacagatcattggcggtggcagctttgttacagatgataatagcgccttcggaaccgtattcaagaatatccccggaggaatgcgtcagaattacttgttgcttccggaagatgtaatgtcacattctgccgaaacgaaggaaatgtctatcggtatgtgggtgaatgcgaaggatgccggaatctcatccacttatatgtggtcaccattattcagtgctcacgggcaggcaccgggcatagcaggtactgccaatacagacaactggcctatgtttgcattgtatgtaagaggaacattacaactgaataatgccggatggtgcaactttgatgatgcacagaatgtaaatggtaccaatgctctatatcatgacgccactgactggttagccgatcacgggtggcattactatacagtaactctcaccgctacttccgccaaagtatatatggatggcgaactgaagaacgaatggcaggtggcaggtaccggagataataatacaattgaaggtgcattcatttatggtgccaactacaaatacatcactttaggcggaaatcaggcgttcgactggggcgatcccgatccgggattcatgtttgacgacttcgcagtctataacaaagaattgtctccggaacagatcaaacagattatggaagacaagactttggctctgcctactcctgtctacatcaatacctttgaagaaggaaccggagatgcaaaaatcgtaggttcgggcaaaatagtttcagtggaagacaaagggttcggacaaatattccagaatgtagccggttctaaaggcactaattatctgatgttgcctcaggatgctctttcccactccgtagaatctcaggaagtgagtattagtgtatgggtgaatgccaagaatgcaggagcatcggacgattatcgctattctcccctattcacggcatacggaaacgagccgtcggcaggatcagagaatatatggccattgtttgtcctgcaatcccgcggacttgcccaaataaactgtaacggatggacagacttcaccgccgcacaaaatgagaaaggtgtcaacaccgtttattgctcggaatatgcagcagatggaatcgtttgtgaggaagactggctgaaggatcatgaatggcatctttacacagccgttctcacgtctaccacctgtaaaatctacattgacggagaagtcgccaactcatggacagtatcgggcagcggtgacggcaataccatctccggaatattcaccaacggtgcagacttgaaatacatctcattgggcggaaaccaggcatggacatgggctgaccctgatcccggatttatgttcgacgacatcgctatctacaacaaagcactgacaatcgatgagatacaggctattatgaaaaagaaaaagaattaaaccttaaagtttagtatacatgaaaaattttatactgatactctgcctcgccacattcagccaatgggtgtatgcgcagaacaagcagatcaccggacgggtagttgataccaaaggcgaagccgccattggtgcaagcatacttgaaaaaggaactacaaacggaaccattaccgactttgacggtaatttcaaactgacggtcggaccgaaagccgtgttacaaatcagttatatcggttataagacacaggaaataccagtagccaacaagacgaaactgaatatcactatggaggaagacacggaagtgctggatgaagtcgtagtggtcggatacggtgcgcagaagaaagaaagtgtggtaggtgccatctcgcaggtttcttccaaagaactgttgaaatctccggcagccaatatttcacaagcgattgccggtaagatttcgggtgtaatcacttctcagacttccggtgcgccgggggctgacgatatgaagatttatatccgtggccgtgcttctttcgcaggagacaaccagccgttgattttagtagacggtgtagaacgcgagttctcacagattgctccggatgatatcgaatcgatctctacgttgaaagatgcttccgctactgccgtatatggtgtgcgtggtgcaaacggtgtgatgctgattacaacaaaacgcggtaaggaacagaaaccgactgtcagcctgaccgccaactggcaaatacagtcccctacccgccaggatacttatctggattcttacaattcggttgtattgctggaagaagcgctggctaacgacggactgccttctcaatattcggcatccgacatcgaaatgtataaaagagcctcagcaggacaactcagcggaatcgatgccctcctctacccgaatgtagactggtatgacaccgttttgcgaaacagtgcaccggcacaacgctacaatgtcaatatacagggcggtaccaaacgtatgcgttactttacttctgccgaatattataaccaacagggattgttcaaggaattcagtcaggacgaatacggaaacaagtcaaactccagcttcaagcgtttcgctttccgtgccaatctcgacttcctgatgaccaaagacctgactctttccgtcaacttcgggacacgtttcgaagaacgcagaggaccgaactcgaatgaatcgagagacggaacttacagtcaggcattttatgaaatgaatcatacaccgggatggttgtttccggtatcctataccgtaggtgaaggtgaagaccagaagacattgtacagtggcagttcacaataccagaataatatcgtggcacgttttgccaaagccggtttctaccgctccaccaatacgatcaatgaaacaaatttcattgtggattataagatgaactggctcaccaaagggctggcagcaaaaggaatgttatctttcgactacgacgcttactataggcgtgctttcaatgccgactttgccacttatgagctgaatgaccgtactaattacaattcaatagacgcctatacccagttcaatacggacacggaacttgcttatctgggcaatgaccagactaccacttataaactttacatggaattccagctgaactgggcacgaaaattcggcaaacatgacattaccgctatggcactgtacaaccaaaatgactaccgttatcaggcagaccttgccgaacgttaccaaggactggtagggcgtgccacatacggctacgacgaccgttacctggcagaagtcaacttcggctataacggttcggaaaacttcatgcgaggcagacgcttcggtttcttcccttctttctccgtaggatggagaatcagcaacgaagctttcatgaaaggaacggaggagtggctgaacaatctgaagatccgtgcatcctatggtgaagtaggtaacgatgtatacaaagtgaatggcgtaaaacaacgtttcctgtatcaggcagtgtggacacagatagccaacgactatcacttcggaacaaccggatataccggtatctatgaaagccagtaccctaactatgcagtgacttgggaacgtgctcacaaatacaacctgggactggaatttggtttatggaacggactgctgaacggtaatatcgacgtattctacgaaaagagaaacgatatcctgactccttatctcacccgtccgcaatgggttggcgtcaatatggctgccggcaatctaggagaaaccaacaacaagggtttcgaaatcgaactgaaacatgcgaaccatatcggaaaggactttacctataatgcaagtctgactttctcacacgcccgcaatgaaatccggaacatggacgaacccgccacaaagacagcttatcgcaaacaggaaggtcatccgatcaaccaatacttcggtctggtgtgcgatggttttgtgacccaagccgacttgaacaatcccgattttccggtttctactttcggcaatgtacaggtaggtgacctgaaataccgtgatatgaacggagacggatttatcgatagccgtgatgaaacatttatcggctatagcgatgttcccgaaaacacttacgccttgtctctgggatgcgaatacaaaggcatcggattcagcatcatgtttcagggagtagatcatgtttccagatattatgatgcggaagcaatgtacgctttcgtgaatggcggtaaggtaaaagaacatcatctgaaccgctggaatcccaaccagtcggaagcatacaaccttacccatgccagttatccgctgctccattatgacagctacggcgaccataaccagcgtaaaaactcgttcttcctgaaaaacggtaacttccttcgtctgaagaatatcgaactaagctactcgcttccggcccgatggatcagaaaagtagccatgaacgaatgccgcgtctatgtaaatgcaaacaatctcatcacgtgggataaactggatggtctttgcgatccggaaagtgaaggttccaaccgttacccaattatgaagactgtgaactttggtgtaaacattaaattctaacagatataagacatgaaaaagacaatcatatataccgccttttggttggcaaccgccggaatcgccctgacttcctgtgaagatatattcggtggttttctggacaaacagcccagcaacgaactgacagaagaagaggtattcagccaatggactactacccgtgagttccatttcgatacttacaacttcctgcgccacggtgcctgccgcatcaacaactcatggatggatgcagctaccgacttagccgaaaccagctacgccagcggcggcacgcgtacaagtttcaacatcggtaactattatgccagcggtgccgccactgaactcaccggcacatgggaacactattaccggggtatccgcaaatgcaatatgctgttaaagaacatcgacgacgtgcccaaagctacggatgactcggaagaagcacacgctacctatgtgaaacaatacaaggcggaagctcatttcctccgtgcttatttctactgggaaatgtttctccgctacggtcccgtccccctggttacagatgtactcgatccggacggagacttgctcagcaactataccacccgcccttccttgaaagaatatgtagttgacttcattctgaaagaactgaaagattgcgaagaaggattgatggataaagctacttctgccgaatcgggcaaccccggacgtatcagccagccaatggcacgtgcactgtattcacgtgtcatgctctacatggcaagcgaccgtttcagaagtgaatcgggtatcagctggcagcaagccgccgatgcagcgcaaagcttcatgacggattacggaacactctacggactctacacgactgataccgatccgaagacatgctataccaacgccatcctgaagaacgcacatgacgagaaaaataatgaaacgatcttctggcgtaatgatgtagctgtaggatggggagcgatctataacgatacgccggtaggcgaaggcggcaacggaggtttgtgcccgtcacagaatttagtggatatgtacgatatggcgaacggacagtctcctttcagcagttatgatgaaaccggcgcccctgtttataatggaacagccactccggccatcaacaatgccagcggatacaagagcaatgatccttacagcaatcgtgatccgcgtctggcggcaaccgtgctctacaacggtgtgaattgggggaatggtataattaatgtactcaaaggacaacgggataacccgcaaggaaatgcaaatgcaacgccgaccggatactatacccgcaagtatattccggaagtgatcctgaacaataaccataccggcagcaactaccgtaactggattatcatccgctatgcggaaatcttattgaactacgcagaagccttgaatgaagctggcgggtcacgtgcggacgtactgaatgccatccagcctctccgcgaccgtgtagggatgactgccaaactcacagaccgcagcgatcttcagaccattgccgaccgccgtaacttcatccgcaaggaacgtaccgtcgaactcgcttttgaagatcatcgcgcatgggacgtacgtcgctggaatgtagcggaaaaagcattggcacgtcctatctacggaatggaggttaccaaggaaaacggaaagtttgtctatacacgtaaagttgcccagaaccgggtatttacggagaaaatgtatctctacccgataccggaaggagaagtatggaaaacgaatatcgaaaacaacccgggttggaacaattaactgaatgaatatgcaaccgatgaaattaaataacatacagacaggattcaaaagaatcctgctcaccgtagccacagttttcatgctgggcaacggatgggcgcaagatgctaaagtcctgaaaggacgaatcgtaaatgcagagggtgaacctatcgcaggtgcggtggtcaacgtagcggaagcaagccgcatcgcactctcggacaaggacggtttcttcactttgaagaatgtaaaacctgccgacgagctttatgtaagcagcgtaggttatctgccggcaacagccattgccgactttgatgagaacttcaagattgtcatggatgccgacctggatgaatatgctcatacgactccgcttcctttcaaccgcaaacccaagaagtttgtgacagagtccacctccatcgtcaccggagaagaactggaaaaacatccggtaaccgttttgcagaatgcgtttacctccactgtcaccggtgtagagacgtatgaggcgcaatccgaaccgggatggagtgaaacagctatgtatatccgtggcatccgtaccatgaatgccagtgcacgcagtccgttgatcatcgtcgacaatgtggaacgtgacctctcattcctcgatgcctaccctattgaatcgattacgatattgaaggatgccgccgccaccgctatctatggaatgcgtggagccaacggcgcagtactcgtaacgaccaaacgcggagaaaccggtaagactaaaatcaacttcacacaagaagtcggcttccagactattgccggaattcccgaaagccagaattcttataactatgcgctgagccgtaatcaggcacgatacctggacggattaagtcccgaatattccgatgaagacctggaatactaccgtcgtgtctgcaacggtgagcagttggaaggaatggccaaatacaaatacttcaatacgaactggcacgacaccatgctgcgggatgcagctccgcaataccgtaccaacctgtctgtcagcggtggtaatgcacgtgcacgctactatgtctccttctcttatctccgccaggaaggtttgttcgacaccaaatggacggaatggaacgaaggatacagcacacaggaagtattgaaccgttacaacctgcgttcgaacatcgacatcgatgtaaacaagtttctgaatgtatcgatggacttgggcggacgtatcgacaatatctcccaaccgggcattgacgtatggaacctctttacctggggagccggcgaaaatcttccggtgtatcccgtattctgcccgaacggtgaattctttatgccaaccagcagcgacagtaaaaacggtgccgcacaaatcgccggacgtggtgtggagcagaaccgccgccgtaacctctatacaaccgtaacggctaccggaaacctggatgccctcgttcccggactgaaagccaagatgacgttcagtttcgactcttacgaaacattccagaaggtgcagcaagccgatgtcaatgtctactactataactatatggctgatgtcaacgacccgtcggaatatacataccaacgcatgagaacgtacaaagcattgcccaatgccaccacttctccacgtgactattactataatctcaatatgaacggcggactggcatacgaacatacattcggcaaacatgccgtcaatgcccaggcttttatccgtacttatcagaatgtagtacgcggacaggaatcatccaaccgctacctctcttacaatgcacaggctacctatgtatataacaaccggtatatcctttccggtaatatctcccgcatgggcagtgataattatgccgacggcgaacgcttcggaacattccccggcggttccgtgggatgggtactttccgaagaatcatggctgaagaactcgttcgtgaatctcctgaaactccgcgcatcctatggacgggcaggacaagccgtaacaggcgtcagccgctacccgtaccaaggtacattcaccgaaggaggcggatataatttcggtacttcccaatcttacacggaaggtgtatatgaatcgacagccggcaacaagaatatcaaatgggaaatctcagatatggcaaacttcggcgttgacttcgacttgtggaacaagaaaatctacggttctgtggacttcttcaaggaatggcgttccaatattctggtatcccgttccaccgtgcccggcttattcggtgtaaacgctccgcaagactcttacggcaaggccgaaacgaaaggttttgagatcactttaggacatagcaaccggatcggtgattttgaatactatatcgacggtatgctgaccttcaacaccaacaagatcaccgaaatggatgaactgactcccgattacgcttatcaggcaagaaccggcaaccggatcgaccaaagccagctcctgatctggaaacaatgggccagtaatcccgacctgattccggagtcgtatgaagatgccgttgccaatcctcagaaatatccgtggaacgctgccggtaaatacaagctcggcaatgccgtattccaggatacgaacggcgaccgtaaaatagacagctacgacaaagtaccgaccggatacacaaatattccggaattaatcccgaccatccgtttaggtttcagttggaaaggtttcgacgcacgtgccgtgctgacggcttatctgaaccgcaccgttccctgtcgcgagaatatggactatggtttcggctggggaggtacttccactcatgaaatcaccaacacatggggatattataccgatgatccgacagacccgcgcaatatcaacgccaaatatccgcgtttgtctacttccttcagtgacctcgaccggaactatccttacaatgagtctaccatctgggtagtcaatggagatttcctttcattgcgcaatgtggaagtcggctactcacttcctgcacgattgatttctaaagtcaatatgacgaaatgccgtctttacttcagcggctacaacctgtgcaactggagccatctgcctaaaggctttgatccggaaaacccgaccaactatatctgggcatatcccaagacacgttcatttacgttcggtgtgaatatcggattctaatcattcaataaaacagcaaagaattatgaaaagaatatcaacttatatagttactctggtcctcgcactcgcaggcagttcgtgcagcgactacctcgacaaagagtacgatgcctccttatctgaaaagaaagtgttcaataaccagaacctgacacgcgagttcctcgccaacatctacacgaatctgccggacggactggcgccactgtcggacgaccagttcacaggtgcttcacgtgactgtatgacggataatgcagtgacctgctggggacttcattattatacaaagatcggcagcgacggatacaccgccggcgaccatcccctgctgggcttctggaacaccgacttatacgggattcggaaatgtaatatgtttctgaagaacgccaaggcatccgtagtaggaaatacggagaaagacggcgatgacaaccgcctttacgaccgttactgtgcagaagccagactgcttcgcgctatcttccatttcgacttaatctgctggttcggcgctgcccctgtcattgcggaagatgaatccggcgaaccgatcatcttcgacttgtccgatccttcggcaatgaacatgttccgtactcccgctgccgaagcacttgaatgggtagccgaccaatgcgaccagatcaaaaaccagctccctttccgctacagcgatgaagcatccaactggggacgtgtcaacggagccgccgcttatgctttaaaggcaagagccctgctctaccgtgcttccaaactgaacaatccggacggcaacaccgcatactgggcgaatgcggcgcaggcagcagccgacttcatcactcagaataacaagcaaagttacccttaccgactgtacaatacgggaaatccggagaatgactattacgaatgtttcacgaccaatccggtatacaacaatgaaattatccttgcacgctctgtatggaataccaatcaggtagaaaaagtattcctgccggtaggctttaccggttctttctccggaaacggacgtaccaacccgacacagaatctggtggacgcttacgaaatgagcaacggcaaacggatcgatgagaacggcagtacctacgatgccgccaatccgtataaagaccgtgacccgcgtctggcacaaaccatcttctatcaaggcatgatgtggggacgtgccgacaaagaagaaagacgtgccatcgacgtacgctacaactcggatgcggacaaaggagtggattacacctcagccatgggaggcacctacaccggatactatctgaaaaagttcgtgaataacatttcctgcaaagaaccggccacctatcctcacgcatggatgattttccgttatggcgaaattctgctgaatgccgccgaagcctataatgaagcggaaggtcctgccaaggcatacagttacatcaatgaggtacgcgcccgtgccggtatgccggcctacgcagatatgtcgcaaagtgaactccgcgaacgtatccgcaacgagagacgcatcgaactggctttcgaagatcatcgtttcttcgatgtacgccgctggaaactatatgacaatgtaacctctacgggagaaaccggaaagccccgttacaaccagttgctgaatctttatggagtgaaggtcaccggcaacgcagatactccctcctataccttcggactggcagaaacggtcaattcacgcacgtttgtcaatcccaagagttactatttcccgatacctgccaacgaagtgaaacgggcacccaatctgggacagaatccgggatgggacaccggaagcgcttctaacgaataaacatcaaaacaatctaaaaaagaaagactgagatatgaaatacttaaagaccatctatcttctactctgttgcacgctcgctctggcagcgtgcagcgacgacgatgaaaactccgcatcaggagctttaagcatcacaacgccggcatatacgaatgtggggtataacaaagcaaccttatccgccaatatcagcggaacggaaggagtgaatatcgtcaaacggggattctgctacgccacggcatcccatccggacatttatgacacgacctccgaagtcagaggatcggaaatcagtacgaccctgaccggcctgactccacagacgacgtattacgtaagagcctttgtcaccctttacaacgaagagcccagatactcggaggaaacttctttcacgactcccgccgagacactgagcgatgaactggcagcgtacgaagcacccacgtatgtagacgactacacaagtttctcagcctggagcaaccgttatgactggaaccttgccaacgtacacgaccctacggtaatgaaaaccgatgacggatattactatatgtatcagacagacgcttcttacggcaacgcgcacagcggaaacggacacttccacgcacggcgttccaaagacctcgtaaactgggagtacctgggagcaactatgagtgaaacgcccccgacatggatcaaagaaaagctgaatgcctaccgtcaggagatgggactggaaccgattgacaatccgtcttacggatactgggcacctgttgcacgaaaagtatcgaacggaaaataccgtatgtattattccatcgtaatcacgaactacatccaaaccggaaaaccggaaattgagaacaacggcaactttgacggttcatggaccgaacgcgcgtttatcggactgatggaaacttccgatccggcaagtaatatatgggaagacaaaggattcgttgtctgctctgccagcgataagggaaagacggattatgggcgcagcagcatcaatgactgggaagggtattttaaaatcaatgcgatcgaccctacttatataataacggaaaatggcgaacactggctgatctatggttcatggcacagcggtatcgctgccctacaggtaaatccggaagacggcaaaccgctgaatgctttgggaaatccctgggacatcacaggggaagacaattcgggttatggaaagataatcgccacacgtggcaccagccgctggcaggcatccgaaggtcccgaagtgatctatcgtgacggttattactatctgttcctggcttacggttcactgtcggtagaatataatacacgtgtctgccgttctaaaaacatcgacggcccttatgtagacatacacggaaattccgctatgggaagcgcgcaactatatccgatactgactgctccttaccggttcgacaacagctacggctgggtaggaatttcccattgcggcatcttcgatgacggagccggcaactggttctatacttcacaaggacgtttccctgtgaacgtaggcggcaatgaatactccaacgccatcatgatgggacatgtacgcagcatccgctgggatgccaacggctggcctctcgttatgcccgaacgttacggagccgttccgcaagcgcctatcacggaaaatgaaatagccggagactgggaacatctggcattgaccaccagtacgggcacccaacgaacgtccgaaacgatgacttatgatctcggtacgcataagataacttccggcagctggaaaaatgctacatggacatttgatgcagcgactcaaaccatcacgacaagcgccggagtagtactctatctgcaacgtgaagtcgactgggaagccagtccgcggacacatacgattgtgtatgcggcccagggtaatcaaaagacatattgggggaagaaactccaataaccctctatagaaaaataaatatgtgttttgctgtcaccgtcacaaagcagagcataactcgcttataatgaagaagtaaagcagtgacagcaactagtgacagcactgtgatggcaatttttgctgtcacagtgctctatatctaccggactttgccgacaggtcatgcgtagtgtcttaccctggatttggttgactactataagtatcaactaaaatgaataaaagatgaaaaagagtgacatgacctttagtccttatcagcttgaacttcttggcgatttctatcgttcgaattacctatacctaattcagctatatttaaaaaacccaaaatattagtagctgttgtattaagtcctaatacctcaatacctaaatggtcgataaaaacttttctagaaatgaaagctaatactaaattaataatataaaacagcaatgctgtttgcatattttttaaacttctcttcgttcgagtatttccgttcatcaatatcaaaagattattgttgattctccttactacccttcaaaatatacctaatttttttgcctaataaattccagctaatagtataacatacagacaaaaatataaataacaaaacataaattcttaatccgatactagaagcatgttgaggtacaaccgcaggttctatcactgcaaaaacaggcttctcctcctgaacttttgctctggctacttgtaactgattggcaacctgactataaacctgataagctaaattcatgtcattttgcaatcgctcctgttccgcacgaacgctttgaagtatgaggttgtcatgtgtatccacataatctgcatatttcttttgagcaacataatactcttgttggcgctctttatatagtttttccaaataaatacaatcttcttccgctttagaaatgcgataaccaacgatacattcttgcaatttatgaactacagaatctgcaacaaccgcagttactttaggatcttgcaaagtaacagagacacttgttatagccgtttttttatcaacagaagcagatatattctttttcaaaacattgacttttataccttcttcttttgttagttcaatagtacccgatttcactttattaagtgaattatcattatcatcactattgaacaaagacttcacaccaccaattaccattccaggcaaacctataacataattccaccaaggagaagattgcctatccaaataatccattaaagttatatctgttctttcatccgataaagcaactttcatatctaataattccaaaagaaaaggagtggacgaaacaatgtcagaggaaagggaagcattcaaagcatcagagacctcacccgtagtagctgaacttcccaaaaaagatgctgcaagtcccgctaaaccattaccacccttggaactccccatttctggagaaagggtaacctttactgtatactgtttaggaatacttactgctacaatcattccaataataaaaccaactccaatggctttgtataattttctacgaatagcaataatcttgcgaaagatatcaaccaaatcaatttctatctcatcactttctgtcttgtgtggttcagagagcaagtttttatcctgtcgttgttctgacataaaagtaaattctattatttctttataagattagcaatagaagcaatcatcattcccaaagaactgaaggaagtagcataacctaaaatattagctatgttccctttcttcttagccttactaggcacaataatctcacaccccggctcaatctgtttcttaccacttcccttaaccttcgtcacctgaccattcatgtaaacaatgaacttcttactcttccttgcattatcagaataaccaccggcctgattcaggtaataatccacattctttcccttcatataagaaaccgtattcggaaccatgacagcaccattgatagttacagtattagtattcttaggtataaagaccacatcaccttcacgtaggacaaggtcggcactacccttaggattagtcaaagccttctccagatcaatgcctaccgtaaaggtatcctcaacaccaatacccaaagagtcaatcatggcttcacccaattgcctgctcatcaggcgaatcacatcacccatacgtttcttctcacccgcacttgccacacgggtcaatttcgcaccacgaagataggcaagactcgtaggaccacccgctttattcaccagatcggaaagacgttcctcacggttggtcatggcataatttcctccgaaaaggatttcaccatcaatgactacattctgttgcgcctgataacccggactgcgacgaacataaacttcgtcataaggctgaaggataaaaccgggctgaccgtcgatgacaaaaccatcctttaaagagaaggtatacatctgaccgatcgtatcattatccgcggtactacggggattcttgattcgtctcgacacatcaatgcggacagtggaggcggcttctttcaagccaccggcctggatgatcagatcctcaagtgtcatgttatcagcatagggataggaatcgggatgcgcgacttcaccgtgaactgtgacattgccacgatcttccagatcgtgaatgctcggaatgtaaaggatgtcattcttcatcagggcgaggttcggggaagtaccgttcatgatagacttgatgtctatctgaacaacttcactggtcaaatcctcacgctggcgataaaggacggcacgattcagaaaagcgtcaccggtcaggccctgggcttcatggacaagttcgcggatcgtattcagtttaccgctgagctggtagataccgggacgatagacagcgccacggatttccagtttgtttgtgaagcggttaaggatggcttcggctgttacaacgtcaccgttacgcattgtgtagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagtccatatccttgaccgtgttgacctcatattcctcaccattctgacggacaacacgcaatgaacgggtgtaggcatcggcttcaaagccgccggcatatttgattaaagtggcaaggttctcgtctttcttcatttcgaaacgcatagggcgttttaccttgccgctgatctttaccaagacatcgtaggcggggacgataaccacgtcaccttcctgaaggcggatgtcatcctgtgtgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaagaaagggcgtaggtacccggctgtacgacctctcccatcacattgatctggatagtacggatattacccaaagtcagacggatgtcggaagtagggtcggtagtattgttcagaccgttatagatcttattcagggcattcttcagatagtcgttggcggcggagactgtcataccgctaaggttgacaggaccgatcttctgaatattgatggtgccttcaggagagatctgctggcggatcgtgttctggctggcaccccagatatcgatgatgacttcatcaccggggcccagacggtaattggcaggagtggcaaggttgacactaggctcgaacgtcaggttgcgggtattgaagatgttgcgcccgaaaacctggtcctcacgggccaaatcttccgtagtcggatgatcttccagcatgtcggaagtattttccttagtctcttcacgaaggcgggactcgttgatatccgtacccgtggattgggaagtgtttacattgttctgctgctcatagagctgcttcacacgcatagcctgttccttggtcacacctttacgcgcaagctcggaagcaagctgcttctgttccttgccttgccggatgccgtcctttacatattccagtacctgtgagtcactcatggactgggccataagcgagccacttcccagcatagaacaaaaaagtagaatgctaaaaagtcgttgtattttcattgacaaataaaaaagttagttggtttcacacagttcctgcataccatgacagaccgcagacaactgttgtttaagaagagaagggggaagaacatcaagaagggtcagagaacgctgcaagacagaccgttttctatcctcgtcttccggattggcgtacatcgacacattatatccctgaaggatggccaaacacagggtagcatcctgctccggtgtctccccccgttgtgaatataaatcgtttatcttttcgtggattgattgttgtaatgcagaaaggtcatcggcgtatacatacccatttttatcaccgatgtgaagtaaatgatctgccagatgttgcagttcatcaatattttcttgtagtaaaaaactcaccataccccttttattcacttaatgcttgtttcacttatatttaaacccttatttctccagaggctctacacaccctactggtatatctacaaaagcacatcccaacatagttagccggactgctactttcgattttccatttactgtaaccaattctccctgaagtccggataatggccctttgataaccttaatcttggttcctggtgacaagggagtcgtactcatattaatcgcctcgtccgaatagtctagcataaatttaaagcggtgcatctgttcatccggaatgacagcaggagtactttctccacgcaataccatatatcggctgatagagcccaatgtcaaaacttctttctgttcatacatatcgacatgcacaaatatcatcatcggaagaagaacacgctcgactacctttcgacgatcactccattgatgcacttcttgctgaacaggaaggaagttttcaatacccattttagatagtcgctcactcgttttcttctcatgagaaatacgtactaaagccaccaaccaacgtttagggtgcgctacgctcctgccagtcacatctgccggcagaacttcttgaatgtcttttttactaaaaatcatctatttaccccacacttattcgttattctttaacaaacagaaacgaataacggtgcaaagatgaccatatttaccaatatacgcaaataaaaaacaataatattttcgttaaacgaccataattagagggaaaaatctgtttgtttcattttcaacacctatttattataccatttacgaacaatgaaatattcaatattttcattgcccagcccttaaaaaagaattaaaagctccacctcaatcagaagattttaccataaaaagaaaaaaaataactattctgagaaaaaaaataaagaaaggatgcagtattctataaactgctgcatttaacttataaacgggagaaaaaaagaatcaaacctatatatcatattaagacctgaaacctgaacttgacaagtggggagaaattagagagagagagtattttacaaacgtccccaaaaacgagaacccctgccgactgtagaagccggcaggggtttatttttactactaaggagtccgaaaagaaagtaagacgttattctttccaagcacctccgcttatttacaatatttttttataagttcatccacattcggatcacccagttccttcgctttattgaagtttccgcaagcttcgtccgtcttcttcaactgtatctgacaaaggcccaacaaccggtatgcttccccatatttcggctcgtctttcagaatttcattcagtatcttcatggattcttcgtaacgtcctacacgcagattaaccactgcatgttctgcccgataagtcaaatctttggggctcaattcaaccgctttcacgatatcatccaatgcacgctgatattgacgggctttcagcgcagcctgctcacgataataatagaaaaggtcattgacctgtccgttcacagccttataataagcatcataatcgagcattgcatttcttgcctgatcgttgttcatatatatctgtgcacgttccagcagataaggagcaaaatttgccgtgacaggctgcggacaacgagcaatgcaactgtccatcaatgccaacacttctttggcatctgccttcagcaattctttcgtcttggcggcactaaagaatgaggctgctgaagccagattgctggcattcaccttctcataagcggccaaagcgcctgcatagtcctgctgtgcaaaaagtatatctccttccaactgcgtataaacgggcaaaggatcgatagccatcgcctgacggagatttttcaaagccgtatcatacgtccagtctttataagtcgtttccggttttgaaagctgataaccgtatatcagcttggcgatattataatacacatcatcctttttagccgccaccttcaaggcttgattaaagtcggctacagccttgtcaaaataagactggtcatccttaccttttgctacgtaatagttggcacggcggatatatccatcggtactgctggggaactggcgaatgaaatcgtccagcaatttctcatattcatcagccgacatctgcgtggaagccataaacagatacaccaatgcctgatcctccgcttcgggcaatcctttccggataccgatattcttcagagcaacgtctcccaaagacagagcactaatcttctgcgacattgcaaaagctgcccctgccgcataacaagtcgttaccgtatccacaccggaggacttctgtgaaataccgaacacctggccttccgcattcatcaccggacaactcaccatcttgtctttcatctgcatactcaaggtatagtaatggtattctccggcaatcttcgatacatccttcactttacccgaaacgcaggcaatgctcttctgcgtagaataaggaagcatccatgcgtcagcgcctgcagccggagcagtagtcgccactaccagtgacggcactttcttctcggtgatggccacacgaaacttgatcacatcgtacatatcatctgctcccaaaatcaggctgaccggcatttgcttgccttcggctgtgacaatcaccgcacgctcagcccctttgaaaagactgtagtcagaaagagccagtccgtcttcggatacgaaaaatccgtttccggtattcagcatcttgtcattcttatcataagttattactgagaaaacagcacgtttcgccttctccacccatttcggggtttgcgccagaccgctctgcaccaagaggaaaagcgctaaaggtaagattaaaagtttcttcatatcagtcgttgtttctttgtttcacagcttcataaatcaaaataccggcagctacggaaacattcagagattcgatggttcccagcatcggtatcttcacccattcgtcacagagagccagatgatcatatgatacaccggtgtcctccgctcccatgatgatacacatcggtcccgtataatcggctttcgtatagtcataatctcctttctcggtagcggcaacgatacggaaaccgctgtccttgagatactgcaaagtcgcacgcagattctgttcgcggcagacaggcaatgtatgcaacgcacctgcggaagtcttcatggcatcggcattcaccgatacgctgccacgcgcaggaataatcaccgcatccaccgcggcacattcgcaggtacgggctatcgcaccaaagttacgcacatccgttatgccatccagcatcacaaaaaacggattcttgccttgctcgaataagaaaggaacgaggtcttccgtcttctgataggtcacagaggaaatgaaggcaaccacaccctgatgattcttccgtgtgatgcggttgatacgttccaccggcacacgctgaacaggaatcagcaatcctttcaatgctgcgaaaagctctttggaaagatcactttgaatgtctttcttaacgagaatcttatcaatctcttttccagcctgaatggcctctatgacggcacggacgccgaaaatcatttcacttttatcggtcattgtaattttgaattataaattttgaattatggattatgaagtacgggccaacagggccttcgcattgctgagggcagcctcggtcaatgtggctccgctcagcatgtgagcgatctcctctacccgttcttcatcggtgagacggcggatatggctgttcgtttccgtatcgctgtccttcttatatactttataatgagcgcgcccgcgagctgcgatctgaggcagatgtgtgatactgatcacctgacggttgcagtcacccatttcctgcatcatatccgccatacggtcggctatttcaccggaaactccggtatcgatctcatcaaatacaatcgtaggcagtttcaccgcaccggcgatcatcgctttgatagaaagcatcacacgcgcaatttcacctccagaagcaacggaagatatgctttgcaacgttccgttcttgttggcggagaacaggaagttgacagtatcctccccctgtatgcccggttctttcttcaatcccatttccacttggaagcggacgttgggcatacccagcgggaccagccgttcagccagttgtttctccacttcacgggcggctgccgcacgggcttttgtcagcacggtggcttgcttcttcacccgttcatactgggcttccttgcgggcagtcagttcggctatgcgatcatcataagaggtgatctcggacaacttactgcgatattggtctgccaaggccatcaattcttcaagtgtctgtacccgatgcttctgttgcagggagtaaatcagattcagacgatcgttcacttcgtccagacgggtaggattaaactcgatggattctccctgcgctgagacttcctgcgaaatatctttcagttcgatgtaggcactttccatgcggtcgctcagttctccggcaggctgatacacctttctcagattattcagcgtattcagattatctttcaggaaagaaagcagtccgccttcgtccgagaaaaaagactgttcgatgcggtaaagccccgctttgatctcctcggcatgactcagagtttccgcctcctgctccagttcgctctgctccccttccaccagatgagcttcctccagttgttccagctggaaacgaagatagtcctcatccgtccggctttgctcggcaagtgccgtcagctcggacaattcacggtcgagcagcttccattcattatacagtaaatgatacttctccagcgcatcatcgttatgagccagaatatcgagtacattcagttggaaaccttctttattgagcaaaagattctgatgctgcgaatgtacatcgatcagttgttcgcccaattccttcacctgtgccagcgaagcaggcgtatcattaatgaatgcgcggcttttgccggacgcctgcacttcgcgccgcaggatacattcctcgtcgtcgtattccagttcgttctcttcaaaaaacgggcgcataccgtaagccgagatatcaaaacgtgcttcgataatacatttagaagctccacgacgaatcgctttcacatcggcacgctgtccgagcagcagaccgatggctcccagaataatcgattttccggcccccgtctcgcctgtgatgaccgagaagcctgtttcaaaaccgatatccagtttttctatcaatgcgtaattctgaatataaagtgaacgtaacaccttctgtaaattaaaaattaaacctaaaaaataaagatcagtgagtcaaaacggcaaccagatggttgatgatgtcttgcgctacttcctgtttgggcttcagaggataatcctcgcgacctttgcgatcaataatgctaatcttgtttgtatcgtgacggaagccggctcccgcatcattcagagagttgaggacgataaagtcaaagtttttacgttcgagctttccttcggcattctgctgttcgttatttgtttcgagggcaaaccccactaacagttgattgtcttctttgatctttcccagacttgcagcaatgtcctgcgtagcctgaagatgcaaggtcagttcttcttccttctcccgtttgatctttttgccggccaccgtttccgggcggaaatcggcgactgccgcacaaagaatccccacgtcggaagtcgggaaacaggtttgcgctgcctcatacatttcctgagcagattccacatctatccggtggatacgcgaatgctgcgttttcagttgcaccggtccggtgatcaatgtcacctctgccccacgacgggcacattcttccgccaaagcaaatcccatcttaccggaagaataattgccgataaaacggaccggatcgatcttttcgtaagtcggtccggcagttatcataattttccttccctgaagttcggcactcgcagagaaaaactcgtccagcactcggataatgttttccggttcttccatacgccctttaccgaccagatggctggcaagttcacccgttgcgggctcaatgatgcggttgccataggaacgcaatatatccagattcttctgtgtagaaggatgtgcatacatatcgaggtccatagccggtgcaatgaataccggagctttggccgaaagataagtggttatcagcatattgtctgctatcccgttcgccatctttccgatggtggaggcggtagcgggtgcgatcagcatggcatccgcccacagacccaagtccacatggctgttccacgtaccgtcccgttgggcaaaaaactcgctgatgaccggcttactggtcaaagccgaaagagtgatgggagtaataaattcttttcccgccggagtaatgaccacctgcacttccgctccctgctttatcagtccgcggataatgtaacaagccttataagcagcgatgctaccggttattccaagaattatcttttttccttttagcattattttgtaatcaaattactcatttcacgcagacggattttagtcagcaccgccttggtattcaacgtgaaatcactgtttaaaatccagctgtagtatccggggtctttcttcagtacctcggctacagacattcctttatattttccgaaattaaatacttccacaccattgtcgtcatacaccatccggccggcaaagtccacattcttagtgaaacttgaatattctgccaggaaggcgatgtcgttctgaagatccggatagcggtcgagctgtgctttcagcacctcataagtggcacgtgtatcggcctcggccgtatgggcgtcttccagactcttttcgcaatagaacttataggcagccgaaagggtacgttgctccatcttgtggaaaatcacctgtacatcgacaaacttgcgcttcgtcatatcgatatctacaccggcacgaagaaattcctctgccaataccggaatatcgaagcgattagagttgaatcctgccaaatcgcagccttcaatgtcacgggccacattctttgccacctccttgaaagtcggacagtccgctacatcggcatcataaatgccatgtacggcagaagaagcttcaggaatatgcatttcgggattgatacgcattgttttcgtttcctcattcccgttaggatatactttcagatagcaaatttcaacgatccggtctgtgttgatattggttcccgttgtctccagatcgaagaacacaatcgggtttttcaaatttaatttcatttctttctttaatggataatggataatggagaattgataatggataggaaacataaaaaatggataactcctgaccactgacagcgcagctcattatccattatccattctcaattatccattaaataattaattaatcgttcagcatcatcggcatcagcagcatcagcaagtcttcattttcttcctgttctaccggcacaatgactccggcacgcgacgggtcggcaagctcgattaccacttcatcggccgaaatattgttcaggatatcgatgaggaaagtagacttgaatccgatgctcatagcggcacccgaatattggcaaacttgtgtttcttcggcagaagtggagaaatcgatgtcctgtgcggaaatcacaatctgattctcctgcatacgcagtttgatcaaactgcttgcctgcgaagagaagatagacacgcggcgcaaagctccgatcagttgctgacggtctacagtcactttatgagggttgttctgcggaattaccgagttgtagttcggatagcgtccttcgatcagacggcagaccatgcggtagctttccagcataaacacagcgttgcgttcgtcaaattcgatggttactgttccctgttctttcggaagcaggtttttcagcaatgtagcgggcttcttcggaaggatgaacgcggcacgttcgtttcctttggcagccagcgttttgcaacgtaccagcttatgaccgtccgatgccaccatcgtgatgtcttctgttgtaatatcgaaatatataccgttcattaccggacggagttcgtcgtcggcagttgcgaataccgaacggttgatgccacccagcagtacacctgcttccatctccacgcggactgcattttcgcccagcacagccgactgcggaaattcgtcagcattctgtcccatcagactatattttccgttctgatactgcacggtgatttcataattgtccgtgttgacgtaaaatgtcaacggttgttccggaatttctttcagtgcatcaagcaatgttttcgctactacggcaaaacgcccgtttgtatcgctttcatttacctcaacggttgtcaccatggtcgtttcactgtcagaaacagtcacagacaatgttccgtcttccaattcgaagagaaaacaatcgagaataggcagcgcattctttgagttaattacacgactgatagcctgtaaatggctggaaagagcagtacttgaaacgataaatttcatatattttcgagtatttaagttttgaattatatatcgcacaaagttacgaaaaaagattcgtgctgcccaagaaaacgaaagaaaaaacaagcattgtgtgagggatattcctaaaaaattgtaacttcgccgcagaatttaaaattatcgcaatggaatttacaggaaaaatcatcgctatcctccctccgagaggtggagtctcaaagactagcggcaacgagtggaaatcacaagagttcgtaatcgaaaaccatgaccaatatccgcgcaaaatgtgtttcgacgtatttggcgccgacaaaatcgaacagttcaacattcagatgggcgaagaactgaccgtatcattcgacgttgacgcccgtcaatggaacgaccgttggttcaacagtatccgtgcatggaaagttgaacgtgtaggcgcaggtgctcctatgactccgggtgcccccgttcctcccccggctccgtctgctactccggatttcactatgggtgacgcaaaagacgacctgccgttctaagaattaaaaacaatctgcataaaaaactcccgatggaactatttctgtcgggagttttttatgactgtcccctgcagtaaccagacaccgggctgaagtgaattcacctcggggccaatgcggattcagcagcgaggcgaaaaggactgagcagcgaggcgaaaggaattgagcagcgagacgaaggagattggacagcgagacggaaaagcccccatgaaggtatgccaaaagtcaatagtaactaaactctcctccttcaggaaggaggagtacccgtagggggaggtggtaggtgaatacataatcctgtcatttacaaagaaataggaacaaacattatttctcctaccacctcggtcttcgaccactcctccttcccgaaggaggagaatagagatagaatcgactttttagtcacccccattcgagatggaatcgattttttagcccccactttagttcttttgacaccccttcatgaattctctcaaaggcatcttacggaatggaataaaaagtgaatcagcggcggcaaaattctctattttttttcttattaattctatttctttagaatagaattatatactcttctctacgaatgtggtctgaagcccaatacgatttccacgtatatgcgtatgcttcggagtatctataatcggggtgtggaggcgggtagtgctccttatgtccaccgcctgttccatgaggtctatacggggggggacgtgcgtcagaaaagggcgcttcctgtcgtcgctcttcgcaggcttctttatgaagatccccagtctgatcgtctccgccgtacccaggctattgccgctctgatgttccagttctgcgggatgtctttcgccgatctgacgcatctggagaaatccgctcttgacagcaatgtgctgcgctacaatcgtgtcaagacgaagactcccatgagcgttgaggttctggacagcgcaaaggagatgctcgaccagctccggaaccgacagtctccccgtcccggttgtcccgactaccttttcagcattcttcaaggtgataagaaaaggaaggatgagagagcctaccgtgaataccagtccgctctccgaagattcaactactgcctgaagtctctggcaaagcggctgcgtctcaacttccccgtcacttcctacacgcttcgtcattcatgggctactactgccaagtaccgtggtgtccctattgagatgatcagcgagtcgcttggtcataagtccatcaagactacgcagatttatctgaaaggctttgaactgaaagagcgtacggaggtaaaccggatgaatttgtcttacgtaaagcggtgcggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggtcagtgcatctgatttagaagcttgatatacagtgtttatcggtgtgcgttacttcttaggtaacggaatgattcatggcgcaaagatggacatatttatgaaaatacgcaaacaaaaatgaaattattttcggaaaatgaatcaaatgcaggcatagctgatgaatattgcaatattcgtgttatgtcttttttttattctaatttttgaaaaacaccttcacatctgctctatttccaagtttatagtcatcttttcatcgtttcgttgaaaaaagttccctgtttagctttccctatgtttgttcgttacctaagaagtaacggataaacatggggtaaaaaaatatgattttaagaaaaaagaaatcactaaatgctgggcctattaatgggacaggggaaggcgtagcacactcaaaacgctggtatgttgctttggttcggatgcaccatgaaaagaaggtttccgagcatttggacaagatgggaatcgagaatttcgttcccgttcaacaggaacttcaccaatggagcgatcgtcgtaagctggtcacctccgtcttgcttcctatgatggtgtttgtacacgccgatcctaaggaacgcatggaagtcctgagtttttctactgtcagccgttacatggtgatgcgcggtgagagtagtcctgctgtaattcctgacgagcagatggctcgtttccgtttcatgcttgattattcggaagaatcgataagcatgaacagttctcctttggcccgtggcgaaaaggttcgcgtgattaaaggtccgttgacgggtcttgttggcgaactggttaatgtggatggcagaagtaagattgctgttcgcttgaatatgctgggatgcgcctgtgttgatatgcctgtcggttatgtagagccgattatggcggctgtttaggccaagggatatggatgctattattttacaagaaaacatagagggtttattaagtttggtacgtatgctgcttcctgatggggggagtgcaggctgcgtgtatttggatgatctttcagcattacaacgatccatccacgaaaagataaacgatttatattctcaacggggggagacaccggaacaggatgctaccctgtgtttggccatccttcagggatataatgtgtcgatgtacgccaatccggaagacgaagaaagaaaacaggctgttttgacccgttctctgtctcttctcgatgttcttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgggatgcaggaactgtgtgaaatcaactgaaacttttttatttgtcaatgaaaatacaaagactttttagcattctactcttctgtttgatgctgggaagtggctcgcttatggctcagtccatgagtgattcacaagtactggaatatgtaaaggacggtatccgccaaggcaaggaacagaagcagcttgcttccgaactagcccgtaagggggtaaccaaagaacaggcaatgcgtgtgaagcagctatacgagcagcagaacaatgtaaacacctcgaaatcaacgggcacggacatcaacgaatcccgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtgaagagactaaggagaatacttctgatatgctggaggatcatccgactactcaggaccttgcccgtggcgatcaggtcttcgggcgcaacatcttcaatacccgtaacctgacatttgaacccagtgttaatctggccactcctaccaattaccgtcttggtcccggtgatgaagtcatcattgatatctggggtgcgagccagaacacgatccgccagcaaatctctcctgaaggtactatcaacattcagaagatcggccctgtcaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaggtaatatccgtactatccagatcaatgtgatgggagaagtcgtgcagccgggtacctacgccctttcttccttctctaccgtcttccatgcgctttaccgtgcaggcggtgtgagtgatatcggcagcctccgaaacgttcaattagtacgcaacggaaagaatatcgccaccatcgacgtctacgaatttatcatgaaaggcaacacacaggatgacatccgccttcaggaaggtgacgtcgtgattgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtccgtcagaatggtgaggaatacgaagtcaacacagtcaaagatatagattacagcatttataaaatgcgtaacggcgatgttgtaacagccgaagccatccttaaccgcttcacaaacaaactggaaatccgtggtgcagtttaccgccccggcatctaccagctcagcggtaaattgaatacgatccgcgaactggtcaatgaagctcaggggctgaccggtgacgcttttctgaatcgtgctgtcctctatcgccagcgtgaggacctgaccagtgaagttgttcaaatagacatcaggtctatcatggacggcacttcgccgaaccttgccctaatgaagaatgacatcctctacatcccaagtatccacgacctggaagatcgtggcaatgtcacagttcacggtgaggttgcccaaccggattcctatccttatgctgataacatgacacttgaggatctgatcatccaggccggtggcttgaaagaagccgcctctactgttcgcattgatgtatcaagacgaatcaagaatcctcgtagtactgcggataatgatacgatcggtcagatgtataccttctctttaaaggatggttttgtcattgacggtcagcccggttttatccttcagccttatgatgaagtttatgtccgtcgtagtcctggctatcaggcacaacagaatgtagccattgaaggtgaaatccttttcggaggaaattacgccatgaccagccgtgaggaacgtctttccgatttggtgaataaagccggtggtccgaccaattatgcctatctgcgtggtgcaaaactgacccgtgtggctaacgctagtgagaagaaacgtatgggtgatgtaattcgccttatgagcaggcaattgggcgaggccatgattgactctttgggtattcgtgtcgaagatacctttacggttggaattgatttggaaaaagccttgagcaatcctaaaagtaatgccgatcttgtcttacgtgaaggagatgtgatctccatacctaataataataataccgtaactatcaatggtgctgtcatggttccgaatacggtttcttatatgcagggcaaggatgtagactactatttgaatcaagccggtggttattctgataatgcgaagaagagtaagaagttcatagtatatatgaatggtcaggtaacgaaggttaagggtagcggcaagaaacagattgaaccgggctgtgagattattgtgcctagtaaagctaagaagaaggctaatattggtaatattttgggttatgctactacgtttagtacattgggaatgatggttgcttctattgccaatttgataaaaaaataagatttatgtcagaacaatcagtagaaaggaaactggaagatatggagattgatttattggatatatttcgtaaaattgtagcaattcgtaagaaaatttataaagcagctaccattggtttgttaattggtattattgtaggggtgagtatccctaaaagatatacggtcactgtaactctttctccggaaatggggaatgataaaggaaacagtgggttgactggcttagctgcctcttttttaggtgggagtgctagtatgggagggggtgttgatgcattaaatgcttccctgtcatcagatattgtatcttctactccttttttgttggagttattgaatatgcaggttatggtagataaaggagaaacaaaaacactatctggttatttaatgacagaatcttccccttggtggagttatatcataggtttacccagtatgtttattagtggagtgaaatctttatttactgatgaagaagaactatttggtgaaagacaacagggtggggtggttatcttaactgagaaagagaaagatcagattgatgcgctaaaaaagaatataacggctattattgataagaaaacggctatcaccaatgttagcgttactttgcagaatcctaaaatagctgcggttatagcagactctgtcgttcatcgtttacaagaacatatcataggctatcgtacttcaaaagcaaaagaagattgtgtttatctggagaagttgtttgaagagaggaagcaggaatattatgctactcaaaaagattatgccgaatatgtggatacacatgataatttaattcttcagagtgtacgtgctgagcaggaacgtttgcagaatgacatgagtttggcatatcaagtatatagtcaggtagccaatcagctgcaggttgccagggctaaagtacaagaggaaaaacctgtgtttgcagtggtggaaccggctgttgttccattgaaagcttcaggattaggtttgaaagtttatgttttactatttgtatttttatttgtttttggtactataagctggatattgatggggaggaatatatttaactgtttgaggaaaaataaaatttgagttttctcatgaagttattttaatatacaatagaataaaaatgtcgtcttctcttataaataaagccacaaagggcgttttttggagtgcaattgaacgtttctcagttcaaggtattcagtttgtactaagtattattattgctcgcttgctattaccatcagattacggactcatagctatgttgagtatatttcttgctgtagcgcagagttttattgatagtggtttttcaaatgcgttgatacagaagcagaaccgtacagagattgattattctactgtattctattttaatataggcatcggtcttttcttctaccttgtattttacatttcttctccttatattgctcttttttattcagagcctcagttatgtttgattacaaaaatagtagggttgaatgtagtgataaattcttttggggtagtgcaaagggcaaagttctcaatcgccttaaattttaggttgcaagctgttgcttcattaacggcagtaattttaagtggagtcttaggggtcagtttagcatattatgggtatggcgcttggtccttggtgatgcaaagtttgttgaataatttttttaatgtattgttgctttggttattatctaaatggtatcctctatggtgtttctcatggaatagtttcaaatctcttttttcatttggaagtaagttattagtgtcgggtcttctacatactttgtatacgaatctttattctttggcaattgggaagaaaatgacttctggggatcttggtttgtataatagggcatctactttggcggcttttccggcaggaaatattacagatgtgatgtataaagctatgttccctgttctttgcactatacaagatagtgatgaagagttggaggtctattttctgaggtatattcgttcagcatgttatgtcgttttccctttgatgattggtttggctgtgttagctgatccttttgttaaagttgttttgacagacagatggtcagggatagttccaatactacaaattttgtcttttgcatatatgtgggatcctgtaatgcgcattaataatcactttttatatgctaaaggtagaacggactatacgctgaaggcagaagtctttaaaaagataattgctttttcgattcttctgttgactattccttttgggctgtatgttatagcttggggagtcgttatttattcatttatagatatatttgtaattacaagatatacttgtataatttctaatgtaacattgaccagtgagataaagaaattatttccagtattattgttagctttaagtatgggagcgtgtgtatggttatcaacctatttcgttatttcttctgtgttaaaacttctctcaggcgttcttattggtgtggtctattatttggtagtttccaagatattcaagtttgaggagatgtgttttttgcaaaatatgattgtgagattgaaaaataagtaatattttataatgagaaatatagcagtaattctagccggtggttccggacaacgattgggtgagaatatacctaaacagtttttaaaaatagcaggtaaaaaagtcattgaacatactattactgtttttcaaaatcattctttgatagatgaaattgtagttgtagtccatccagactatataagggatgtagaagatatttcgttgaggaattctttcaataaactaaaaaaaatattattagggggaaaggaaagataccactctagtttggcagctatcaatgcttatgatgaagaagtgaacttattatttcacgattcagttcgtcctcttgtcaatgagcggattataaacgattgcatccgtgcattgttgacttacaatgccgttgatgtagcaattcctacaacggatactattattcaagtagatgataataatgagattgtcaaaataccctcacgcatattattgcgtaatggacaaacacctcaggcatttaaacgttctgttataaaagccgcttatgaaaaagctttgcttgatcccttgtttaaaacaactgatgactgtggtgtagttttaaaatatttgcctgatgaatctatttatgtagtcaatggagagcaatttaatatgaagttgacatataaagaagatatttttcttttagataaactttttcaattgcgtagcattaggaaccagcccactttattggaaaaatcggaaatggaggaactacaaggaaaggtagttgtagtttttgggggtacgtatggtatcggacaagatatttgtgaaatttgtcgggaatataaaacgtcgttgtatgtatacagtcgttctacaggagtggatgtgtcgaatagtcaaagtgtaaggagagttttatctgaaatatttgataaggaaggacggattgactggatcgttaataccgctggtatattggacaaacagcctttggcgaatatgagttatgaagcggtacatcaaagcattgatgtaaattatttaggtaatattattgttgcaaaagaatcttttttttatttgaaagaaagtaaaggatcgttgttgttttttacttctagctcttatacacgcggaagggcgttgtatagtttatattcatcgtctaaagctgctattgtaaactttgtacaagctttgagtgaagagtggtttgaatatggtattcgtgtgaattgcatcaacccagaacgtactaagacccctatgcgtattcagaattttggaaatgaaccggaagatactttattagaaccgaaagtggtagcaatcgtatcagtaaatactttgctatcggaaatgacaggtgaggttgttgatgtaaaaagataaaattgtatgatgttggttatcaaacacttattaggatactttattttacttgtatcttatgtttttccccgtatttcaaccatttgggtctttggaggagagaataatgcaaaatatttatattataagctaaatgaaaaggcggcagatattaattgtatttggatttcaaagtctaaagaagaggttgcacaagtgtgttctttaaaatataaggctttttatctttggagtttgaaggggctgttttattcattaatagctggacgttatatttatacgttttctgtttcagatataaatccttggactattggttggacaaaaagagtaaacttatggcatggcgtgggtattaagaatgttgaatttaaatgtaagcttggtccattggcaaaaaagtataatccgaatagtcttaaatctcgcttcctttacccatatttatttttcagacctcatttgtttttatcaacctctcctttaatgactaaacattttacagagtgtttcagaatttcggaagatagatgtatagaggctatgtatccaagaaatgaaattttattatgggcacatgatcagatagaagaatttcttaaacgatataataaagagcaggaactggatgtaatagaggattgtgcaagttattcttatgtatatatttatatgccaacttggagagaggataaacgtaacatactagagattattgatttcgacagattgaatcaactctgtattaaaaacaataatctatttttgtttaggctacatccaaatacggaaataaacttagatatgttagtgagttattcaaatttaaggataattgattcttcttgtgatatatatccaatttataatgaactggcttattcacctaggtgatagagactgttcacccgggtggaacgatgaagatgtcggttagataacagaataagatatataggataacatctaggatacagtgacttaacatacaaacaactgctggttttaaacagatatagcggaccacatcttatgtacttactttgatgtgagagatagcaatgagagataaccgaaaactagtggttttgatggaaaaacaatgagagatacctgttcggaaaggtatctctcattcattatattaatgattgtcagcatactagatattccacagtgagaccgtgagactaaaattattttttttctttctagaagagtctttttccaataatgacaaaggattcattgtaacaggcaaaagcagcacataccgctttgatgatattggggaactgccctctatgaatatgacaatgatgcatatggaatcacaatgataaaaaataatgtgtcaatgcagtcatcattaaaaaaaggcactactccttatttcaaatccgagagattttcactacattcacagcatgaaatgcagaattatacttggactatcagccattctcttttttacaggatgttataatagagaacatatttcccggcttgacgaggcggaagctctgttacaaaacaagccggacagtgccttgacaatattaaagcagctcagacaggaaggcagtcaggccgaacaggccagatatgccttgctttactcggaagcattagataaaaaccatattaaagtaacggatgattcactgattcgccaggcttggagccattataaacactattccaaagatttacgacaccaatgtaagactctctattattggggacgaatcaaactacgggcaggagacaaaccgggagcattgcgcctttttctcaaaatagaagagaaactgaaagacaccaatgaaccttattatacaggactgttatacgggcaaatcggtgaagtatattatgaacagatgaactacagccgggcttatcattatttccgtgaagcccgcaataacttccggcagtcggataatgtacgtgaagaaacggagtcaacacttgatatggcagccgcagcttttcattcgaaagacatagagaaagcaatgcgtctctacgccgccgctcttgatctggccgacgaacaaaagaacgatcacctggcaaaagccagcctcacgaaccttgcctctctttatgtagtatcgggcaagcggcaaattcctcatgacttgctgcaacgcatcgagctttccgcccgacaggataccctgtacggctaccatacactggtagatgtgaaccttctgaaaaatcgtatagacagcgcacgctactatctggctctcgcagaagcacagactaccgacatccgtgacttggccgacctgcaatataccgcatatcgtattgaagcacaaaccaggaactttgagaaagcaaccgataacatacatcgttatatctatctgactgattcgctgacacgctcaaacatgcagttttccgccggcatggtggaacgcgaatattttaaagaacggactgactttgccgaataccggatgaaaaaccgtactacctgggaaatcgcagcagcaactgtaatccttctgatgataggagtggcttattacatcacccgccaacgcctgcgactgcaacgcgaacgcaccgaccgctatctgctactggcagaagaagctaattccgagtataaaactctgaccgaacgcatggaaggacagcgcaatactgaaaaccatctaaaaggattgatagcctctcgttttgacattatcgacaaattgggaaaaacttactacgaacgcgagaataccgcatcacaacaggccgccatgttccacgaagtgaaacaaataatcaccgattttgcagaaaacaatgaaatgctgcaagaactggagcttatcgtaaatacctgccatgacaacgccatgcaaaaactccggaatgatttccctgcaatgaaagaagctgacattcggttactctgctatatctttgtaggtttttcaccacaagtaataagcctgttcatgaaagatacggtagccaatgtatatgcccggaagtcacgacttaaatcacgtatcaaatcagcagagactgctaacaaggacctgtttttatcacttttcggataggtgttaggccagtgttagaaatctgagaacccattcaaaataactatctgaatatcaacactattaaaacaccagtgttagatttacaagatcgtaccataactcaaaaatgatatgatcttactacttttgcattcgaaaaaattgaaaaaagagaagattatgagaaagattgttattctgctaggtatcatactttttatgatagcgtgcgaaaaaggaaacgaagaagtgagagaagctaaagtagtggttgtcgtttatgatgaaaatggaaaaattgcaacgggtattcccgtaaagatgtataatgaaaaagattataaagtttttgagaaagataatctgaccttacctactgcggttgcccgaaccaatgaaagcgggatagccacctttattttaccgcaagaagaatggttcgcagcacagtcgcagcggttctttacgttcgtggtacaagaaggtggcggacctgataactaccagatatggtcttccggcagaaccgtagaagcaggtaaggtagtgaaaatagaaatacgtttaacccaattccctaactaagcttttatcacaatgaaacaaactaaacttaatatattaatagtactttgcctgcaaatgatgacaggacttacattactgagttgcagcactgaaaacgatgaattcaagaaggaactgcctccaacggagcaaccatctgaacccacaggagccttacttgaacgtttttccatagaccagctgcctgcaaaaacgatttatgcattaggagagagtatagacttaactggactcaaagtgacaggtgaatatgatgatgggaaacaacggtccgtgaatgttgccccaaaacagatcagtggtttctcgtcatctgtccctgtcgacaaacaggaagtgaccataacaatagaaggaaagcagaaaagctttactattcaggtggcgcctgtccgtgtggaaaacggagttctgacagaagtcctgaaagggtacgatgaaatcatactccccaacagcgtgaaatccattcctaaaaacgctttcaacggcagtaaaataaacaaggtgacactcaatgagggactgaaatccatcggagatatggctttcttcaattcaactattcaggaagttatatttccctcgactctggaacagcttgaggaaaacatattctactattgctatcaccttaaaaaagcagatttaagccggactaaactcactaaacttcccgcaagcacctttgtatatgcgggcgttgaagaagtgttattacctgctacgttgacagaaatcgatgcacaggcattcctcaagacgtctcaactgaaaacgattgagattccggagaacgtcagaacaatcgggctggaagcattccgggaaagtagcattacaaccgtgaagttaccgaatggtgttacaaacatagcgcaaagagccttttattactgtccggaattaacggaagtgacaacttacggaactgttttcaatgatgatcccgaagctatgattcacccttactgtctggaaggatgtccccaattaacacgtttcgaaattccacaaagtatccggatattgggacaaggattattgggcggtaacagaaaagtcactcaactgaccattccggcaaatgtgacacagattaatttttcagcattcaataacacaggtatcaaagaagtcaaggtagaagggataacacccccacaagtatttgaaaagatatggtacggatttccggatgacattactgtcattcgtgttcccgccgaatctgtagagaaatataaaaccgcagccggttggcaagactacacaaacaaaatacaagcgtcctgatgatttatctgaattttcggttatcattgtaaaagtcgattccacatctgctttttatgatgataatcggaaattcttttttattcggtttctgtcagatatattcagtaaatattccgctatatattcttctttactcccaaatactgttctattttccagttttattctttatctttgacgcaataaaaccacttcgaattcacaaatatagaaaacggcaagaggatgccagacatatagttatgactatactaattattatagctgtagtagtagtgattttcatcgctatttacaactcactggtgcgaaaaagaaatgagacggaaaatgctttcgcagccatcgacgtaatgctgaaaaagagatacgacttgattcctaatctggtaactacagtcaaagaatatgcagaacatgaaaaaagcacattcgcacagattacggaaatgcgcaacaagtcgtacgcatctttctctaatcaggataaagaaaatctggactctgctttctcacaagcctgtacacacttttttgccattgcagaaaattatccgcaactgaaagcgtctgaaaacttcgaacagttacaacgtgcgcttaacgaaactgaagagcagctttcggcagcacgccgaacttttaacgcttgcgtcactgactataataatgcagtacagactttcccgtcaaatctgttggccggtatgtttggtttcacacgcaaaagcgtattctccatttccgaacaggaacgtactgttccgaatgtgaataacttgttgaatcagtaaaaaacaatatataatatggcagaaagtccgcaatttgagacattggtacaaagtctttcctctactctgcaaagtcttgaacagaaacgcaaagaactaaaaaagcaaggacattccaccggaatatgggtaggagggattattctcgtgattggtattgcattttccctttatgcccatgtagcacttattggaatcggtattgcggcaggtcttgctttgttggcatactacagttgtataaatgccaaatcgcaggagttatccacctattataaacaggaagtaatcgcacaaatattacaatctttttgtgaaaatgccgtcttcacacccgaagagggaatcaaggaaagtacattcaggaactgtgccctgttcacttctcccgaccgttatcacacagaagatctgatacagggacgtgtaggaaaaacggacttctgctgtgcggaaattcatgccgaagaacgaaaaacacgtgtcaattcaaaaggacagacaagtcattattgggtagatatctttaaaggtttctttttcattgccgattttcagaaagactttcagggacataccactattttaaggaatagcctgttcaaactaagctccagcggttcgcgggtgaaactggaaaatccggatttcgagaaaacattcgatgtttactctacagaccagattgaagcacgctaccttctttctccttcaatgatggaacgacttcttgcactagacagagaattcaataagaacatcacaattagtttcagagattcaaatattctgatagctattcctgaatcaagaaatcattttgaagccagcatctggaaaccgatggatgaccttagccagctcaaaaacgatttcagcatgattcatgcattggtctctattgtagaggacttgaatcttaatacacgaatctggagcaaaaaataaaacgaatcagcagaaacagaacccgttttatatgtcgaacttaatagaggtttgattgatacttctatagagtttctgcaactcaaatctccccgttgactcctaatccaaataaagcaaaatcacccaggcaaggatcatccggaaagacttcagccaatgcagcggtgatccgacgggcattcttcaaagaaaaagtttccgtatccgtcaacttgaagtaataagctaccctacagacatgagtatctaacggaacaatcaggtctttacgatcaaaactctcccaaacacccaaatcaacctccgaatcccgacgaatcatccaacgtaaaaacatattcagtttcttttgaggacttttggcagaaacttcgagaaatgcacataacttctccataggtattccggaatatatattcaaagcatcttccaaacttccgaactgcgtataggccgtatataaccgacggaagtatccatgaaaatcagcatacgacagcatccgataaaaactatgggttgccccggaaggaaaatcttcctcccaccggcgggataatacatattgataaggtgaagttcccattagcttatgcaactcatccgctttcttcaatatctgcttgcgattgccaaaactcataattgccgtcagcagtccgctaatctctatatcttgtttcagcgtataacgatgagggaactgcaccggatcacttgcgataaagcctgcacaatggtacacctctgcacacatcaaaagtttattctttatatcttcagtcatttcgagaaagtatcaatcattgaaagtacaaaagtacatattctgtttggatttcctcttcaagtacagaatggattgtattcccaatagaataacgaacagatattccgccgtcatatacaccgtcaaagaggcatgaaaacactcactcagcaaatatagataaatcagatagatcaggatagtaaccagttgaaagacaaaggcaagtcttgtctttcccgtacctgtaacagcattgatataaacatatccgggcaatgcaaacacataattcaacaacatgactataaaaggccagaaagcaagttttactaaataatcgttatttgtataaaatccgatgatccattgattgccccaaagagctgtcagtatcaatggaagccctaccacatagcctaatctgagaactttgcggcaaacgggaaaaagttccttcccctgtcctcccccgatcagattgctaactaacgatccggtagtagaagcgaaagaattgactatcacaaaaaagagggtagacacacttcgggtaatattggaaatagcaagttctgtcttccccaaatgttcaatagccacaaaaaacaaaaaccagggagcgacactgataaaagcatgaagcatactccatacggacagttgcagtagtttcatcagcaatctgccatcatagacggcactcagaccatattttttcttatctaccgttttacacatatataacaagagtatgagaaacgctccaaactcagcaatggaggaggccatcgctgctccggatatgcccatatctagtttgaatatcagtaaatagttgaaaggaatattgatacagactgccgtaagagctgctccggagaggagtttagtattcgtgaccccaaccaggaaagcccggaaagctaagaaaggaaacgaaaataacaatccgaaactacgccagttcaggtaacggatcacagcctgataaatttcatcagaagtaatcagctgttgcagaataaacggagaaacaagatgtatcagcagacaaagcatgattgccatcaccatcagaaaatataatccctgaaagaaggtacgccctgtttctttgtaatgctgctccccatttcttcgggcaatcataacctgcagaccaatgctgaatccaaatcccagcatataaatcgctaaataatatattcccgcaagtgcggatgctcccaattcgatttctcctacgtgtcctaaaaagacagcatcggtaatgttgattaattgctccattagaatgctcatcatcacaggaaagttgatgagccatatttgcttatatgtatatttcattgctcaactaaaaatagcacgatacagcatactacactcatagcagtacacagtttcgtaaattcataaaaatgggtataaaaactctttggcaagcgggtcgttgcttaccggatagctgaatagcctgattagaaaggatgctattcgttgagcgtagctatatacagagtttcataaatagatggatatactattagttcattaatcacgctacaaagatagtcatttttatatcatctcctaatatggtatggtattagcagattacatctagtaatggactgcttcagaagcgggaataatagaattaataatttgattctgaacaacatacctgataatcaaatagcagatcgatggcaacagaccatctctatttgaaaaaaggcatatcattttgaaaagatcagtaaccaataaattatcagataacaatgaaagtttgcaaatttgaaaaaatgaaagaagaggatgaaatcagacaagtaatcaattacatcctaaaggaacatccttacgtagttgtggttccgacactgacgcaactacaagaatggctgcaggatatttctatcagctggtttcacgaagaagacagtgcttcgcatacaacaatcaataatatcgaagaatattgctgcacactggcagatcacctcataacagatttgccactaaatacggatataaagaaatatatccgggaatgtatcgaaaagatgcacaaactggtggaggacaaagccgatttattaattgataaaataataaaagccgaaatataccggttatccggagaattgtttgcctgctgcctgcgtcagcatggactgaatgcccgcacattggataccggtacttttatgcagatgaatctggaaaggaaaccggatatcccctacattcaggaatctatcaggcagtatatcaatgagaatcgggatactgacattttcatcgctcctctttccttatgcaaaaatgtatatggcgaaattgatttcatgaatgagaagcgtaatgattattatgctaccgtactcgccagcatattcgaagcagacgaaatcattctgtcaaccgaactcacgaatatctatgccaaccggaactgtgccagggaacaacattctctgacctacaccgaagccgaacagttgattaacagtggagtacacttaatttatacagactgtatcactcttgcagcccgttccaatatcgttatccgcttaatagacacccatgacctggaaacagaacggctctacatctcttcccatgatacggaaagcagtgttaaagccattattgtccaagactcagtgacgtttgtacgcttcacgtcattgaacgtcctgcccggctatttactcatgggcaaattactggaagtcattaataaatatcagataaacgttatctcaatggcctcatccaatgtttctgtctccatgattctgacagccagtcgtgataccctgcgaataattcaaagagaactgcacaaatacacagaaatggttgttgacgaaaatatgtccgtaatacatatcataggatcacttcattgggaacgtacgcaactggaaagtaacatcatggaaacaatcaggcatatccccatatcactgatttcttatggcggcagcgatcattgtttcacaatatcagttcacacggctgataagaagcaattactcaattcgctgtcacagcgttttcttgaaagactttcagcctgattaacaaagtaataaatacaaatccataaaaacatgaaaattacaattataggagccggaaacatagggagcgcagttgctgcctgtctggcaaaaggacatctctacaacgaaaaagatattatcatttctacccctcatacagacaagctagaaaatctgcacaaacaatttcctgcgatacgcataatgacagagaatcagtatgccatatcggaagccgacattattattctggctgtcaaaccatgtatagtagacgaagtattatctccgttacgattctcacgcacccaaatcctggtttcactggtaaccggaatatccatttctcacctggcacatttatcggaaaccgaaatgcctatattccgggttgttccaaacatcgccattacggaacattcgagcctgaccctgataacttcacgcaaagccggcaaagaacaccagcaactcataaaacagacatttgaagaaggaggaaagtgtttgttcgcagaagagaaacagctggatatcatttctgcattaacttccagtggaatcgctttcgcattaaaatatattcatgcagccatgcaagccggcatagaattgggtatctccgctgaagatgcaatgcgaatgacggcatatagcatggaaggagctacagaactgattttaaatcacgacacccacccgctgttagaaatagaaaaagcagctactcccggtggagccaccattaaaggattgaatgaactggagcacaggggatttacttccgccgttattcatgccataaaaagtagcgccacagtatcgaccgataaagagactgaagaatagacaaacgatcccctaaattttcacgcacataatttcgcactaatataaagtatatatttttcatataaagaagaagatactaacagcattattatacgtttattatacattaaaaagagttaccctatacacagagtaactctttctaaattcagttcttcaggttcagatttaacttacgatactttatatcgacaattctttacttataagttaatggaacttcaaagatgttcacgaacagcattctttattatccaaagctaaaagggaaagtgctttcatcagataaagcaattaatccatttttccgctggatacaaattttgttctctctcgccagccaaccggcggctaatgctgtactctctacgctaaggtttaatcttctcgccaattctggtatcgaaatttcaccaatttctttcagggcacaccagaccttgccggcattgttccctactactcttttatccatggctattctctattaataattcgaaactaagatagctattttaataatagttcataacatattctcttattttatttaacagattgacattatttaaagattcaaaaaagaatcgggttcaaacagttaaatattcggtcatattttatactaaagcaccattctggaatactcaaaatcatcaaataaattcatagcataactaaaagagaatcaacaggttttattaaaaaaaatgaataatagcaatatcggacaagttcgttcccttttttaccaatacctttgcgaagtgaaataccaaaagaagttatgcaacagaagaaaacaaccaaagaagagtatcaaaagtgcgtaaatgttgtggtggaatatatcaatcaacatttaggagaagacattgatttgaaatcgctggccaggatatcaaacttttctcctttttattttcaccgaattatgaaagcattcctcggtgaaccgatcggtacctttattgtccggacgcggacagaagcagccgcacgtttattgcgctattcggatattcctattgccgatattgcctatcgcatcggatattcatccccttcttccttgtcgaaagtgttcagacagttttatggtatttctcctttagagtatcgaaacaataaaaactttgtaattatgaaaccagcgattatcaggccagacctggaactgaaaagtgaaattaagagtatacctgcacgcaatgttatttatatccgcctgtccggtgactacaaactgaatgactacggagggacatggggacgtctgtggcagttcatcaaagaacaaaagctgccgatgggagatttcagcccgctctgcatctatcacgacgaccccaaagtgacaccagccgagaaattgcgcaccgatgtatgtatggtgatgcccgtacaggtagctcccaaaggagatgtaggattcaagacacttccggcaggacgttatgcaatcttcttatataaaggtacgtatgacaatctgcaagcggtatatgatactatctatggaaaatgtctgcccgaaatggaatgtacgctacgcgatgaacccagtgccgaacgctatctgaacaatccgtgcgaaaccgctcccgaagagctgttgacagagatttatattccggtagaataagaaggatttaaaaataaatgagactgcatccataaaaaatgcagtctcattctactttcgctcatcattacccatcagagggcaactacgccggacagataatcttcctctcttttatctgttatttatcagcgtaaagccctaccctgtttccctcgctatccgcaaacaaggcaaaccagcctctgccctctacttcgattttcgtcttgggcatcatgatttttccacctttccgaaggactttttccagtgtctgatcgatgtcttcacaattaaaagagataatcactcctttttccgaaggaagataatcgggagcatgaaaaatagcgccgaccgtttcaccttcttccgtgaaacacgccatcttctcctcttcacattcaaaaaccggaagctgtaccccaaacactgtttcatagaaatcgacagcccggtgaaaatcaactgtaggaatctcaaaaaatgcaataaactttttcatttcgttctttttttatggttactattgagcctttgcaaagacactgcaaaagtaagggatgccacaaagctctgataggaaaaaaaagacattttcaaaattccgagaagtaatcagaataaggagcacaaacagaaagatattctgcaggcgtataaccggaaaatagtttgaattccttgatcatgtgggactgatcggagtatccacattcataggccacttgtacaaaaggcaaagtcacatcctgttgcaacagaaataaagcacgttgcatacgcacaatacgaagatattccttgggagtcgtaccgacatgatcggcaaaaacacgtccgaactgcttgctactcaaacaagccgcctccgacaattgaggaatatttatctgtggttgaagattgatttcctgaaagacagcagacatcctcttcagattatactcggaaaaagcatataaacgacgaagaaaaaactgctctatcagacgaatacagactatattatcagaagtatcagtgacttgcttcgccaaatccgatagttcgacatcttccacttcatccatcgctacatctttcccatgaaacaagtgaacgggaatgtggagcaaggctttcgctgcataaggttgaaaaacaaccgtaatcatctctatcctacccgtcgacaacacatcggagaatccgatcgactgtccgcaaataaaagactgtggctgcaactttaaatcattctgcaggaagagttgtttccctttatgaaaaacaagttgcatacaaccgatgggcaaagtccgttcggaaacaggaactgctgcatcatcctgcaatatccaataatggcggatgtaaggcgatagcacaggaacgggctttataatctgaaatgactgcatatggcaaagatatcacttttttaattatggaagcaaaagtagatagtctctttgaatctgtattgtaaaaaagagacatttaattattaaatcaaacctaaagaattatccttctgttaaaatgataaaaagaatagaagtatttatgtcttttttcttttttattgtctaatattgttctctattaatacacacaatacataaaaccatatggatgctcaaggacttcgtctcataactgctcttaaactgtgcatactagccactaaaaaagatggtacacctttatatagtgacagagagcaatacatcttctccgaattatatggtttggaaggaaacgaaatacaaaatatgataagtttgggagataaattaggacttagtcgtgaaagaatccgtcaattaaaagtaaaagtattcaagaaattcggaattttaagaaaaagaaatatcccagccatcattgacattgataatctattgactaataatcaccagatcaatcttgatgaagtacacaattttgcttgctacttaaaaaaatttcaagaaagccatctgtctgaatatcccatagaaactctttttgatctagctcaactttactttaaacaggattattccattatcaaaacctggaaaagagaaatcaaagaaacaagcacaatctttcccaaaaagcaaaattcacaattgacagatattacaaacaaaattatatggtttgatcatgtgaagtcatggactcttgaagaaatccaccaaataactcctcatagaaactatgacccaaacaaaaaatatttagaatcagaagctggagagttctatagtaataaacttcaaagaaatgttttttacgaatcgatgcttgagaaaaaattctataaacgtttagaaaaatcacatgaggttatttattatgtcgaacaaggcattacaatcacatacgatagaggaaaatatacccctgatgctatagtcttccttgatgatgggaaaggtttcgttgtagaaattaagcctttgaccgaaatggccaaccaatctgtacaaaaaaaattcaaggcattacttgatttttgtgaagaaacaggtcttggagctactttaacagatgggcgtacagatatcaatcatatattcgaaactattccaaatctcgctttcgaagaaagcatcttgcaatctttgaaagaatttaagaaacttacttatggtaaagtaaacgaattaaaaaataaatatcaagtaacgactatacatctgctacaatgcattataaaaaataatttatcctataactccatgccgacatttatttggaaaactaaaaagcccattatatgtgatttacttttaagtcctgaaaataagatgttattaaaaggatcgacagatattatcaataacgacaaaacataaaatatgcctcgcctgggtataatataatagccaggcaaggggtcttatttttcaaataacagaaagcccgtattcataggcttctgacatcgcctgatattctttgtccgaatatgcacctttacttcttgccttctgcatatcattcataaaggacttaacggtagaaaggaagctctgaaaattcttcagttcttcatcataacctgtaacagccggaattttttccgcagccttcagttccttctccaactccgccattttcaaatcaatccgtactccgtccattgcatgtttgcgggaatacaaattcattatgctctgcaccgtgcctgacatcttgcgcatcgccattatctgatctttcaacggctcatcagccaaaagttcactctccgcttgttcggtcaaaggacttaggatatcaaaaatcacttgcttatactcggacagttctacgctcaacttatagttttcatccaaaagctgagccgtttttgctgtatctttcgacttcttataagctagaaatttattgaagttatcatagaactgtgtccgcacattaaacaatccggcataattctgctttagattctgacggacttcaggattaaaatagtctcccgggtccaacaattccgctgtatcacgggcagctatttccggaggtgcaatcgggtcaacttcaggcactttccctgtctgttccatgtatcccaacacagcatttatatctttcgcattagccacatgcctcaatacagcgagcgacatatgataataattgatcaccttactggcatcatccaattcctccgtactttccgaggatacagtctgctttttacttccccccgaacaggaagacaacagcaaagcaccgaccagtgctccaaacaataaaaatttctttttcataatgttctccttattagttactttccgtactataacaataaaaaacgatttttgttatgtacaaacaataggtatcacatacacttacaacggtggaaaaattcaagatgctattaacgatgattaaagaataaacaattatcgacgtataaaaacaaaaaatggctactcatcacgagcaaccaatcttttgttaaccttaaatctaatacttatgaaaaaaacacagtacaaatataccacctttcaagtaaatagcaaatttcagagccgaatcggacgataatataacacggtttaagactctcggaagcgcattaacatttcagacttttcgtgttaacatttaacatattcattcacagttcctgcttaaagaaattcttgaaaaagcaactaagtccgctttttcaagaatttcgcattaatcctttttcagtatactctattctccctcctatccgtactattgattatttttcatcacggaattattgcaatacaaccaattttaccgtaactttgaaatatgataattagcgccagccgccggacagatattccggcattctattcgcaatggttcttcaaccggattaaagaaggatatgtgttagttcccaatccttttaatcctaaaatgatcagcaaggtcagcttacatcctgctgtgatagattgcatcgtgttctggaccaagaatcccgccccgatgattgataaactggatcatctgcaagactacaaatactactttcagttcaccctcaatccttacggagagaaattagagaataatctgccgtcagtcaacaaacgaatagacatattcaaacgcctttcggataaaataggaaaagaaaaagtgatctggcgctatgacccgatactgaccaatgaagagtacgacgtttctttccataaggaggcgtttgcccaaattgcctatggacttaaagaccataccgaaaagtgtatgctgggatttattgaccattaccagcatatccgcaccgcagtcggccagttcaacatacagccgttgcgaaaagaggagattgaagaaatagccgtctctttcaggaataccatcaacgaatatcctgccatccaactagatacctgcacctccaaagttgatctgagacatttgggaatccctgccggactgtgtatcgacaaagaactgatcgaaagaatcaccggctaccccctccttgccaaaaaagacaaaaatcagcggaatgtctgcaattgcattgaaagtatcgacataggcacttatgaaagttgcctcaacggatgcatctattgttacgccatcaaaggcaattacaacagtgtggaatataacactaagaaacatgacaggaattcgcctttgctgatcgggcatccggcagaagatgatgtagtgaaggaacgggaaatgaaaagtctgcgaaacaatcaatattcattattctgaatcacgcccggactccaaataattccttcgcataagagcaaaaaaaaggctatctatcccagacagccaatctttgttaaccttaaatctaatactatgaaaaacacagtacaaagatacggacttttgcctcatctccaaattttccggctaaaacgggacatcttataacatggtttaatagaatcagaaccgcattaacaaataagcaacttcatgttaacatttagcagtcttcttaaatatttagcccataaaactgaatgagatgcaaaagttttcgaatctgttgccgattcctattaataagagtttacaggcaacaacaaatccattcattagctgttaattagaggaaggtaatcatcaaattctcaacatatatgaaaagatttgaaaacaaagtagtcgtcatcaccggtgctgccggtggcattggcgaagcaaccacacgccgcatcgtctccgaaggaggaaaagtagtcatcgccgatctttcgcaggaaagggccgacaagcttgccgccgaactcactcaagcaggggccgacgtgcgtcccatctatttctccgccaccgaactccaaagctgtaaagaactggttgatttcgccatgaaggaatacggtcagatagacgtacttataaacaacgtaggcggaaccgaccccaaacgtgatctgaatattgaaaagctggatatcgattacttcgacgaagtattccatctgaacctttgctgcacgatgtatctttctcagcaggtcattcccatcatgaccactcacggaggcggaaatatcgtaaacgtagcatctataagcggactgacagccgacgccaacggcactctctacggagccagcaaagcaggtgtcatcaatctgaccaaatatatcgccacccaaatgggaaagaaaaatatccgctgcaatgccgtagcaccgggactggttcttacccctgccgcactggacaatctgaacgaagaagtacgcaatatatttctgggacaatgcgccacgccttatttgggagaacccgaagacgttgccgccactattgcattcctggcctccaacgatgcacgatacatcaccggacagacgattgtggtagacggtggcttaaccattcacaatcctaccgttgaattatcataaatataccccggacagtacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctttttatcataagaacgatgaaggtgtgtcaaaaatcaaaagtaactaaactgaggctgactaaaaagtcagttgtatccacactctcctccttcgggaagaggagtacccgtaggaggaggtggtaggtgagcacacaagctattgatattcaaccatacagcatacctaccactccggctttcagccactcttccttcctgaagaggggagtttagttacttttgacacaccttcataaagccagatgtactgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttattctctttctcgtctccctcagcatactccaaagccgttttttctaattaacaaataaaaagtccctttttccccgctaatcggacacagcagccccgatggcagcaacggaaagatcgtgaccaatacctcttcacttaccacagcactgcatatcgtcaagagtataaccattcatatccaataaacaaagtaaataaaaggctgcaactatgagcaggttattactataagcatccgttctctctttaacgagaaaaaattctcatgccttcgagaaaaaattctcattgcagtgagaactttttctcaatgcgatgagaaacttttctcatagtggtgagaattttttctcatcaccatgagaatgattgagaatatagtaatccgtatcatactgtataataatcatatacgtattttgcgtcttacggtttacagcaataattgattggttataaagaagcttattcataaaaaaagtattttttcgcctattttgttgaagcatcaccgctatagaaagcgaaaacaccctaaaagtgggattaacttactaaaagaaggaattattgccaattaatcagtaggattgttcaacaaatgctaactttacgacgttttacatataaagaataaacggcatgattgtaagaacactactggatacagacctctataagtttaccacctcgtacgcttatatcaaattattcccttacgcaatgggcactttcagtttcaacgacagaaacgaaactgaatataccgaagagtttctggaagcgctcaaaagcgaattcaacaaactcagccggttgagacttacggaagaggaactggaatacatgacacgcaattgccggtttcttcctagagtctattgggaatggctgtcttctttccgttttgatccggacaagatcgatattcatctggacacaacgggccggctgcatattgaagtcagcgattttctttataaagtcacactgtatgaagtaccgctgctcgccatcgtatccgaaatcaaaaacaagtttttcggcaatgtacccgatatgagcgagatactctgcaaattgtcggagaaagtggaattgtccaatcagcaccagctccgcttctcggagttcggcacgcggagaagattctcaatcgacgtgcaggagacggtgatcaaacggctgaatgatacggccaaatactgtaccggaacttccaactgctattttgccatgaagtacggcatgaaaatgatgggaactcatccgcatgagtggttcatgtttcatggggcacagttcggatataagcacgccaactatatggcgctcgaaaactgggtgaatgtatatgacggagatttgggcattgcgctgtccgacacttatacttcaggaatattcctgagcaatctcagccgcaagcaggccaagctattcgacggagtgcgctgcgattccggcaatgagtttgattttatcgataagctggtagcccgctataaagaactgggcattgatgccactaccaaaacaatcgtcttcagcaacgctctcgacttcacgaaggcactggaaattcaggaatactgcaaggacaagattcgctgttccttcggaatcggtaccaatcttacgaatgatacaggatttgccccttccaacattgtcatgaaactcacgcaatgcaaaatgaatgtcaatcaggaatggagagaatgcatcaaactatcggatgacgagggaaaacatacaggcagtccggaggaagtacaggcttgtctatacgaactgaggctggcgaaataaagaccactctgaacagaaagccgggatacgggcataaaaaaaggagcaacgccttgctccaacctttgttaaccttaaatctaatactatgaaaaacacagtgcaaagatacgtacttctgtgttattagcaaattatccaaataaaaaagtatgttttataacacgatttaaaactttcatagaaaaacatccctttttattaatactttttcaagatttaaactccttgactgctcttcccaatctttccagcgtcagttcgccggattgtctccagagctgttcaccttttctgaaaagaatgaatgtgggagtggattcaatggtatagaaattagcgagatcactttcctcgtctacgtctacctgtactacctcgactatcccttccatctctttcttgaactcttttatcaaaggctgcatacgctggcagtgaggacaccacgttgcataaaattctgccattacccagtcatcacccgccagtttctctctgtttctcgtatcacgagctattttcttttctttcatatcgattctccttttaattaattagtgggagtcttaacaatacaaaaaggggaaggtttaacacataaacattaatacacagagatttagttctattggaaaagtaaaggagaggaaatctgccggagcattcattgcacaaaactgaaactttcgtgcaaaaacagaacacagtattcaatatttatttatctttgccccccgaaatggttcggagtccgtgtccaacggacaacgattaaaagggaatcgggtgtaaatcccgtacagtcccgctgctgtgaagctctatacaatgtcttattaatgaactaatttatcgccactgatgttatttcgggaaggcactataagacaagagtcagtcagaagacctgccacttcgcgtaaagcgttcttctgcctcgtgggttaggagaaagaacatcatttgttaagccccaaatcaagaaaatactgtgtttctgtcggatggactatgtctgtgaagatgggaaggcattaaataagtatgtacttaattgagtaaagtatgataaaaaaaatcttagtagccaatcgcggtgaaattgccataagggtgatgcgctcctgccgggagatggagataacgagtatcgctattttctccgaagcagaccggaccgcgaagcacgtgctctatgcagacgaagcttattgcgtaggaccggcagcatccaaagagagttatctgaatatagaaaaaatcatcgaagtggcaaaggaatgccatgcagacgctattcatccgggatatggtttcctgtccgaaaacgcgactttcgcccgacgctgtcaggaagaaaatattatttttatcggaccggaccccgaaacgatggaggcaatgggcgacaagatatccgcccgtattaaaatgatcgaggcaggagtccctgtcgttcccggcacacaggagaatctgaaaagtgtggaagaagccgtagaactctgcaacaagatcggttacccggtgatgctgaaagcatctatgggcggcggcggaaaaggtatgcgccttatccacagtgcggaagaggtggaagaggcttatacgactgccaaaagcgagtcactttcttcgtttggcgacgataccgtttatctggagaagttcgtggaagaacctcatcacattgaatttcagattctgggcgacaaacacggaaacgtgattcacctgtgcgaacgcgaatgttccgtacagcgccgcaaccagaagattgtagaagagacgccatcggttttcgtgactcccgaactacgtaaagacatgggtgaaaaggcggtagccgccgccaaagcggtcaactatatcggtgcaggcacgattgagttcttggttgataagcatcgcaattattacttcctcgaaatgaacacccgtctgcaagtagaacatccgattacggaagaagtggtcggagtggacttggtgaaagagcagatcaaagttgccgacggccaagtgctccagctgaaacagaaagatatccaacagcgcggccatgccatcgaatgccgtatttgtgccgaagacacggaaatgaacttcatgccgagcccgggaatcatcaagcagattacagaaccgaacggaatcggtgttcgtatcgacagttacgtttacgaaggatatgaaatcccgatctattatgacccgatgatcggcaaactgatcgtatgggctactaaccgcgaatatgccatcgaacggatgcgccgcgtactccatgagtataaactgacaggggtaaagaacaacatcagctacctgcgtgccatcatggacactccggactttgtggaaggccattacgacacaggctttatcaccaagaacggcgagcatctgcaacaatgtatcatgcgcaccagcgaacgtgccgaaaacattgccatgattgctgcctacatggattatctgatgaatcttgaagaaaacagaggtgacgcaacggacaaccgtcccatcagcaaatggaaagaattcggtttgcacaaaggtgtacttcgtatctaaactaaaaacagcattcaattatggaaattcatataggagaccgcgtagcggaaatagaactcgtcagcaaggaagacaacaaagtggtacttaccattgacggaaaaccgtttgaagcagatgttgtgatggccgaaaatggcacctgcaatattctgatggacggtcgcagcgcaaacgcacaactgattcgccgcgaaaacggtaaaagctataaggtaaatacgcattatagcagtttcaatgttgaaatcgtggacagccaggcaaagtatctgcgtatgcgcaagaaaggtgaagacgaacagaacgaccgtatcacttccccaatgccgggaaaggtggtgaaaatccctgttacggcagggcaggaaatgaggaccggagataccgtcatcgtcatcgaagccatgaaaatgcagagcaactacaaagtgacttccgattgccgcatcaaggaaattctggttcaggaaggcgacaacatcaccggtgaccagacattaataacattagagccgattatataatactaaaaacggattgcatcatggaagaaataaataaagcatacgccatgtttcaggaacgtgaccgcatcgcttccctcggtgggggcgtggaaaagattgaaaagcaacacgaaagcggaaagatgactgcccgcgaacgcatcgaaatgctgctcgacaaaggtacttttgttgaactggacaagttgatggttcaccgctgcaccaactatggcatggacaaaaacaagattccgggagacggcatcgtatccggttacggaaagattgacgggcgccaggtatttgtttatgcctacgactttactgtctacggaggttcactgtccgcttcgaacgcgaaaaagattgtgaaagtgcagcaactggcattgaagaacggtgctccgataattgcgctgaatgattccggtggcgcacgtattcaggaaggaattgaaagcctttccggctatgcggatattttctatcagaacacaatggcaagcggagtgattcctcagatttcagctattcttggtccgtgtgccggaggcgcctgctactctcctgcccttaccgacttcatctttatggtgaaagaaaagagtcacatgtttgtgacaggtccggatgtggtaaagactgtgattcacgaagaggtaagcaaagaagaactgggcggtgccatgacacacagcagcaaaagcggtgtcactcactttatgtgcaataccgaagaagaactgttgatgagcattcgcgaactgctttccttcttgcctcagaataatatggacgaaacgaaaaagcagaactgtactgacgaaaccaaccgtgaagatgccgtactcgacaccatcgtccccgcagacccgaatgtaccatatgacatgaaggatatcatcgaacgggtagtagataacggctatttcttcgaagtaatgactaacttcgcaaagaatatcatcatcggttttgcacgtctggcaggccgttcggttggtattgtcgccaatcagccggcctaccttgccggtgttctcgacattgacgccagcgacaaggcaagccgtttcatccgtttctgcgactgtttcaacattccgttgattactttcgaagatgtgccgggatttcttcccggatatacgcaggagaacaacggtatcatccgccacggtgctaaaatcgtttatgcgtttgccgaagctaccgttcccaaactgacagtcattacccgcaaggcatacggcggcgcatatattgtgatgaactccaaacagacaggtgcagatgtgaacttcgcttatccgagtgcggaaatcgcagtcatgggtgcggaaggtgcggtaaacatcctgttccgcaaagcggatgcagagacaaaaggtaaagaactggaagcctacaaggaaaagtttgccactccctaccaggctgccgaactgggattcatcgacgaaatcatctatccgagacaaacccgcaaacgtctgatccaggcactggaaatgacagagaacaagatgcagacgaatccgcctaaaaaacatggaaatatgcctttataagttataggcgattacctataataaaagagactgtttcagtacaggtgcccccacctgtttctgaaacagtttctttttttcatataaaaagcagaaatgctttcacgcaaaatagataaaactttatacctttgcagtattacattatgaaaaaccagaaaatatgattaacctgaaatgtacatttgccgtcacggccggattgtgctcatctttggcctatgcacaaaaacaaccgcacattatcttaattatgaccgatcagcaacgtggcgacgccatgggatgcatgggtaatgaatctcttatctccccccatctggacgctttggcaagcgaaggaacgttgtttatgaacggatattcttcgtgtcccagcagtacccctgcccgtgccggactgttgaccggacagtctccctggcatcatggcttgttaggatacggtaaagttgcccccaagtacaaccacgaaatgcctcagatgctgaaagatgccggatattataccttcggtatcggaaaaatgcactggcatccgcaacgaatcaaacacggtttcgaaggaacgctgctggatgaaagcggacgccgggaagatccgaatttcatcagtgactatcgcttatggtttcaaatacaggcaccgggaaagaacccggatgaaaccggaatcggatggaacgatcacggagcagctacctataaactgaaagaaagtctgcaccctacttattggaccggtgaaatggcttgtcagatgatacagaattatgataacggcaatcagcccttattcttgaaagtttcctttgcccgtccccacagcccgtacgacccgcctcaacgctttctcgacatgtataaggatgcgcaggttcccgatcccgtcattggtgagtggtgtgggaaatatgccaaagaactggaccccgaaaaagcagccaaagatgctccctacggcaacttcggaaatgaatatgcacgtcactccaaacgctattattatgccaacatcactttcatagacgaacagatagggcgtgtcctccagaccttaaaagacaagggaatgtatgataattcccttatcattttcgtttccgatcatggagatatgatgggagatcactaccactggcgaaagacttacccgtatgaaggatctacgcacataccttatattattaaatggccagccaaagcgcaagtcgttcccggcaaggtggataatcccgtagaactccgtgacctgctaccaactttcttcgaaatagcgggaacctccgttcccaccgacatagacggacgctctctgctatctctggctaaaggcacagaaacggaatggcgcaaatacatcgacctggaacatgccacttgctacagtgatgacaactattggtgtgccttgaccgacggaaagattaaatatatctggtacttctatacaggtgaagagcaattgtttgaccttgccaaagatcctaaagaactgcacaatgctgtgaacgacaagaaatataaaaagctgctgacaggaatgcgtgcagaaatgatccgccacctcagtgaacggggagaggaatttgtgaaagacggtcaattggttgtccgcaaaaaaacgatgctttacggtcctaactatccgaaagaaaagcgataaatatagcctgcccggatgaaacgcatcactttcgccacaaattgtatctatcatacagataaaatgggaagttctcaatgactgacacttaatttatccgtctaagattgtacaatttgcggtgaaagtgataataagtattttgcaagaagacgtttttcccttacatcagataaggagtgagatacttcacaaggaaatatcctccgaccaccagccacacataaagtaaaagagccagtacgaaaggtttggctccggcctttctgaatttatcgatgcttgtttctgttccgagtgccgtcatagccattgtcagcagaaaggtatccagtgtgttaatacctgccaccaactgcgcaggaagcaaatcaaaagaattgaaagcgatgacacccataaaacctattgcaaaccagggcactgcaatcttctgaaacttctgccctttctgcacttgtcttttccgcgctctcgccaccagataggtagtaatcagaagcacaggaaccaacatcatcacacgaatcattttcactatgatggcagaatccgaaataccgtttcccatcgcgtctccggcacctactacatgggcaacctcatgcagggtagcccccgtataaattcccatctgatcgggagtcagtgcacaaaatccgttccggtacaagaaaggatacagaaacatggaaatagtaccgaaaatcacgacagtagacacggatacagccgttttatatggctttgccttgatggtcgattcagcccccagaatggcggcggctccacaaattccacttccgatggaagtaagtaatgcgattccacggtccatcttcagcaatttaccaagatagataccgccacaaatagtcaccgccacaataatcacatcgatcagcatagccggcaacccgatagccatcacatcctgaaaagtcaatctgaagccatataaaatgataccgatacgcagaatcttcttcgagcaaaactggatacccggcacccacgtttccggaaggtgatttcgcagactattggcataaagcatacccaaaatgataccgacaatcatcggactgaaagaaatacttcttacaaaagacatctcgccaatataaaacgcagcacaagaaaataatgctatcaacaggacaccgtgcagcatgctgcttctcttttcattgaacataaatgatttgatttaagtgatactaaattatttcttttttgcaaaggaagacattttccggcagactgaatcacagaattttattatgtcggataatccctggttatacccccaaagcggttataacaaaaaaacggcacctcgattcacatcgcagcaccgtcacaacacaaacacaaaataaaacacgacaaaactactatgcaatcttacctgtaatgccggggaggcataccttgcttgacttatctatattcgcatacccataagaagctttatcaggcgatttgcataataaataacgcaccaattcggattttgttcacaagagttctgaaaaaaatgaagttaagacgactttttaacaaaaaaaacggtaccccgattcacatcgcagcaccgtcacaacacaaacacaaaataaaacacgacaaaactactatgcaatcttcctgttatgccggggaggcatattcactgactcatatatattcgcatacctacaagcagtcatcaggcgatttgcacatatataacatcccgattttcgttttgttcacgaaaaaaagagattgaagtttattttctccctttaaaatctttcagaaagccttccatcaaccatttggcaagggcctgacggttggaatccatcaccagtctccgctggtcaaatgtattctgtatattccccagttcgacaaaaacagaagcgggggtagtgtgtgaaagtacatataaattgcgtccgctcaccgttccggaaaagccgcggttcggctgatgctttccatatttggattcgaacgtatctttcatattgtttgccagccgtttgctttcggctttcttattggaatgatagaaaaagacatccgtctgcttttttttgctgcggctgtctacatgaatgaagatagcgcggcagtaagtatagttctgacggtctttccgataaagagcattgattttattgcaacgctgctgaagacgctgtacctgattcaatggaatcgggtcgcccatacaagtctcacgcttgctgttagagaggtaagcgtcattacggataccatctttggcatcctgaataatgatatgcacttccgccccttcctgcatcagattccgggcgagacgaagtgcaatgtcataggcatattcgtcttcgtgaagttcgtgcttccctacccgtccgatggctcccggatcaggaccgccatgcccgctgactacatagaagcaggcacctgccagtcggttggaagtgacctttacattcgccagttgcttaccgaaaagaggttcatgaagagtggttcctattttcgaagcctttgaggattgttttcttgccggtgtctctttatcagccgccgccgatctcttgacaggaggaatagtatacgttacccccagcttcaacacattccctttccccagctttgccttattcagttccacaaaatcatcataatatttctttggagcacggttgtgccgcagcaaaaaagtagaaatcccctcacctgctttcggagtagctttttgttgcgcctgcacatcagccaacgaaagaagaaaactaattaataaaagaatatagaatctttttttcatattcgactactaccttatcagtatcatttcacttataaacaggacaaaaatacaattattttccctacttttgccccgttaaaactttttttggcaataaaacttaaaaccctatatcattatggcaaaacaattcaaacccgaaaccctgtgcgtacaggccggatggacgcctaaaaagggtgagccgcgtgtgctgcccatctatcagagtacaactttcaaatacgataccagcgaacaaatggcacgccttttcgatttggaagacagtggttatttttatacccgcctgcaaaacccgactaatgacgcggttgccgccaagattgccgcccttgaaggtggtgtagctgctatgcttacatccagcggccaggcagccaacttttatgccattttcaatatctgccaggcaggagatcatttcgtttgttcatccgccatctacggaggaacattcaacttgttcggtgtcaccatgaagaaactcggcatcgacgttacattcgttaatccggatgccagcgaagaagaaatctcggcagctttccagcctaatacaaaagcactgttcggagaaacaatctccaatccttctctcgaagtgctggatatcgaaaagtttgcccgtatcgcacacagtcacggagtacctttgattgtagacaatacattcccgactcctatcaactgccgtcctttcgaatggggagcagacatcatcgttcattctactaccaagtacatggatggacacgcaacaagcgtaggtggctgtatcgtcgacagcggcaacttcgactgggatgcccatgcagacaaattccccggactctgtacaccggacgaatcttatcatggtctgacctatacaaaagcattcggcaaaggtgcttacatcaccaaagcaactgcacaactgatgcgtgacctcggcagtatccaaagcccgcaaaattctttcttactgaatcttggactcgaaacactgcacctgcgtatgcctcagcattgccgtaacgctcagaaagtagcagaatatctttctaagaacgagaaagtggcctgggttaactattgcggcctgccggataacaaatactatgcactggcacagaaatatatgccgaacggttcctgcggagtgatctccttcggactgaaaggcggacgtgatgtctctatcaagtttatggattcattagaatttatcgctattgtgactcacgtagctgatgcccgtagttgtgtgcttcaccccgccagccatactcaccgccagttgtcggatgagcagctgatggaagcaggtgtacgtcccgacttaatccgtttgtccgtaggtatcgagaatgcggatgatatcattgcggatattgagcaagcgttgaatgcgtaaaagctgattactatcagataacaaacagcaaaggcacaggacattttgattctgtgcctttctcttttcaccaatgcttcatccctttcttatttactgcctatcatcctacttctcaataagaaagttaatttctaacagaatatgtttaatcatgaactgataaatcgctatagatgtttatctttgtaaggaaccaaactctgtatagatatgaaaaagattttattagtagcactcgcgctgtgcctttcttacggatttgcttattcctgtttattcaatcattcaattaatctgaccacaaagatgcagaacttcgaaacggattcgtttaccaccaagaacgggaaaagcctgaaaatcactttctttaagcatgccagcttgttaatagaatatgctggaaaaaagttttttgttgatccagtctctgattacgcagactttacacaacaaccgaaagctgactatatcctgataacacatgaacaccatgaccatttcgataccaaagcaattgctgcgatcgaaaccccggatacaaaaattattgccaatccgaattgccagaagatgctggacaaaggacaagccatgaaaaatggtgatatactgcaaattacacccgaaatcaaactggaagcagtacctgcttataatacaactcccggtagagataaattccatcccaagggacgtgacaacggatatatcctcactgtgggcggcacccggatttacattgccggagacacggaagatatcccggaaatgaaacaaataaagaatatcgatatagccttcctgcctgtcaaccaaccgtatacgatgacaccggaacaagctatacaatctgcaaaaaccattcaaccacatattttgtatccgtaccattacggagatacgaatatcaatgaagtgaaggacggattaaaaaacgaaaaagaaatagaagtacgtatccgtgctttacaataaaaatacaaacctagttgaaaaataaaaggacgttcctggggaaaaaggggaaatgtgggaacaggaacgtccttagaaacataataatacaaaaatccggactttcgcaagggcgcatctttgtttctcgtcttatggatatccccttcaagctaagggctgcgattctttatgggaattgcagccctttttgttgctttaaattaatatttatcactaaaataacgatgtccaagtttataataaacttgggggacgtttataataaacgatgaaggaatttattaataaacgattggaagttactgcataatcggtcaatatctttcgtatagatatggatgctgaccttgaaaagttctttatcctttaaataagtaaatgaattattgcgacaatgattcttttctttttttatgtcataggactaaaaacctcactgtaccattacgaatgaatcgacaaggaaacaatgcatgactttactactgactcaaaagaaaagcggactatcaatggcgggaatcttcccgccgactgatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtagtggcagatgatccccaagtaaagttgctcttcaatgccgaattggacttcaagtacggttgctgaaccttcggtcccttcgtccattcttccgattcggatgtcaatgtattcaacaggtcttggaagtgcatggaaactacgtgtttcgggtccggattcttgtaatattccagatattccatcggtacatataccgtgctcggccatgtcttaaagacagtacaccaggttgtcggttgggtagcaccttcgtcggcatcactacgggcaacttccttacactggaacggtaatgacttcaagtgcaaagtcttgagtgccgtcacattatcaaagatgtatccgtaaacataagtcatggtactcgggaaccaagcttcatttactactgagttaccgaacgcgtgacgaccgatataagtcggaccttcgttcaccactaccgttctcagcttggtacagttacgacaagcttctctcggtacgtattgcaatcctgtcgggaatgaaatattctccagaaggttacatccgttgaatacaccattcttcagcgtttcattctccacttccgtcatatccagagttttcaggttgtagcccttacccgctgtcatcatgttcttcagtaagttcaaatcggtatcgttgagtctgcccttcaattccaggctagtgatggattcccaatctttatagatttcgtcatcaataagactctgcaatacatttgtcaaacctcccggagccggaatttcaatctgagtggccgcagcctgacggataaccatatagtctttcttgttttcataacccttgcgatagatgtaaacggtagcctgacgttctctcagtaccttattcacatcgtacgtgaagatgacacgttcgggcatcgagttgtttgccatgtgcagccaaccattctctgccgtatagccactttcttccggatatacgatatccaccaaaatctcgttcttcggatcggtcaacgtagactgtacgctatacttcacggtagcggcactgcccagcttatccaaacttgttctgaaatcgttcttgttggtaataaccaattccacatcgcttgcctgagcttgagtcacgataaactcttctctcaccttcttgtcggcagcggcacaaagcgcgatcgttgccgtacgttcgccaccggtattttctttcacggaaacgaggaaggtagagtcgcccttggcatctatagcaggcttgaacgaaatccaatcctgatcgttcttatcaatatcaatcgtcaaatcccttggtccgttggtattggttgctttatatttcaacagaatcgaatcttctttcgatgccaggttagtgaacatttccttgttatcgaccgtaatgacaggtttgggcagaccggtctggaagatattcatcgtagcctttacattatcattatctttcgaagagatttcaatggtacctctacgaatatcaaacttctgattcggcaacaccttaaagtacagtgtatggttttccatcgcacgtgtctccggttcgcctgcggggcgttcgtccgtcggcatgatccagcccgtgtcaccggaatagaggaaactggttttatactctcctgtgttaattccaaactctacggaaatgatatgctcaccggcatccaggttttcgtaggccttcgggtcggtgattaccaccgcatccttctgtgcctgatagataacgaaatcatacttaaagccaccggacacgagagaaaaattagcacggcgtgcatccggttccacattttcggctgcagctacccatactttgttgccttcgccggccgttccttcgcgttcaaacagcactacccagctattatccacaccttccgaatcatccaatacgatatgccaatcctgattggcgttgaatgtcagtacttgagcggaatttcccgcagaagagaaactgaaggtggacgcttcgttcacgatctccaatttaggctctagcggcgtcaccacttccggaccagtttcatcgtcaccacatgcagtcagtaacgatgccaccaaacatccggtcaagccgatatatttccaattgataaaatttatcgctttcatgcttatttcactttaaattcttcttttacaatattaaggtatttcataccgtatccattcccgtaattcgggtcagtcggttcgatagcctgatccacattccaacggttaaaagaatcgatgatgaccatcggacgctttcccaagttcatcttggcaacattacacatcttacggaacatatcttcatccttaaataccaccgggaagttatagaactgagttccatcaccatctatccactgattgaacgaaggtgaaacgctaggtacgaagtctactccgtaattagcccactcatattcgcggttgtacttaaagttctggtcgatgcactgcggatagcaggtagggcggaaccagtcggtctgattgtacatattatccatgtacacagcatccacttttccgctcaggaagaagttatgccagcgtgcaggaggtgtccaacgttcctgacgtgctaaaatatagatctccagtccattgccattgccgtcctttacattttcacgcactctttcacggatcgtattatagagtttctctgaatcgcgtgcatacaacttgtcagcattccagacaacaatcatcggtttgccgtctacagtatagtaaagatcgttgttcgtacagaaacggcttgtcaggttgacaaaaaagctgtaaagttgctcacaacgtgcagagacaccattttcatcggcatcgtcttctatcatggcggtgttgttaagtccgtttgcgaagttattcatatccatagaaaccgcataacgcaagccaccccattcgataccttccgagttgggattcagtcccgccatatagttcacgaaattcacgttaccttcgttcagcaaatctcccttactggtatccagaccgatgttcggcaagataaggaaattgataccggcattatttgcccaggtaaggtgctgctgaatcaaatcggctgtttcggctttattgatatccatcgaataacgtcccagcaccggacgcacattcggacaaagctgtggatactgtccgctctgattatattcaccaatcaaccgcgcatacttcttttcatccacacccgtactacccaagttccaataaatggctcctaccggaatatcgctgctcggtctgatttgcggaatctcatagttcaagaaatgatcatcgatggaaggaccgtcatctgtcggtgaacaggccgatccggccaccagtcccaacgtcaggcatattgcaagacctgtcttattaaaaatcttatactttttcatttttcagtcattacttaattactacttttctaccttataaactaaaagtgtagcttctatcaagaagttgtaagccttgtccaaagcctcttcagcctccttgataccggtcagctcacgggcattcttcaagaactcttcataagtctgtccatacttcttggcttggaaatccatgttgaactgtacataatcgctgttttcccatccggctatcatctcttcctggttaggtacaggttttgcgaactgaagcatcgtgaagatattgtctccccaacgggcggcattaggtttcggactattcttctgtaacaaatcaatagctctgtaataagcctctgcatttgtctgacgttccgcatccgggaagtaaaggcgttcgggccagccgtagtacatatttccgccttcttcataagcctgagatccgttcaggaacagaggcggaaggttcaatgcacgtgtgcggcgttccatacgccaggcagacattccatccaggaagtcggcaaaccagcgttgtttgtagatttgttccaattgtccgtccttaccgtctgctccgttgatgtcggcagtcatcagtttacgggtatcatagaatcctttatgactggttccccaggcgattccttcctgagccatataggcagcagcagaagcagacaagccgttctcttcgaacgaagcacggatgccttcttcataataggtctgtgcatccttggatcccaagtcgaacttcactttcgcttcagcgcagaggaaacaagcatctgcccagcgcagcaaaggcatcgtagcgtccattgcataatatctcgggttgatgtagcatctgttgtcttcgttcattgacaacggatcagggatttctcttgtaccattcgggtcggtcgggtcgatcggtcttctccagccgaacggtgtacgggcgcccggattgtccggtgtaggaacgtatggaatagagtaacgtacacgcaatgaatcacgcacttcatatccatctatcatccattgcaggtgttcctgctgatcgctggcggaacaaccgctcacatcacagtcgtgtgaacgagtcagcacatccgtcatacgataaggctggcgttccggccaataaacgttggagccgtcaaagtaagtctccatacgcggatcgttgtatgagaacaggtaaatggcgaaatattcgttcatggaagggatcagcccccagtttgctttcgtctgaatttcttctttatacaaacgagtgtaataccaggaacagtctttgtcgatcaccgttccatatttgggagcaaacgcatcgtccagagagctgaacagccattcttcatgtcccatagatttcgcagcatattcgcgtgctttctcttcgctgatattctggatattcatggctatctccaggcgtaatgtattagccagtttgcgccatttctgtacatctccgttataaacagggtctttcagaatcttatcagtagatgattcgtcgaactcatcgactgcctggtccagccaacccaaaatggaatagtaagcatcggcttccgaatcatagtcaaagatacgcttgtccgttcctccgtccataccggcatggctcagtccgaccggaccatagagtgacagcaactggtagtaagtgaatgctttccatgtctttacaacagccagactgttaggcaaagagccatcatcgtatgcttttgccaactcttccaggtcgcgcagaatctctacataaaacttacggtagaatccgtctcccctttcgttccacggtgtctggaaagcgacgttagtaatgtaacgtgaataactccacatacggttattattcaattcactgattgcattcattgtcttgtaaaccgtaccggggaaaatactctgcagatttacctcatacaatttgttcgggtccgagttgatggtttcgaaaccgtccgtacaccccacggcagtcgatgccagcaggagtaacggtaatattttgtttttcaatttcatgctttacgaatttaaaaagaaactttaatatcaaatccataggttgcggaaggcaggttgaaaccacgttcgaaaccttgtgcatttcctgttgtactcgttgcctgcggatcaagcccgtgcggtgtattggcaaacaaggtagcaatgtttcgtccgacagccgccacacggaatgtctggaacggagtctttctcagccattttttcggtaaatcgtagctgacagtgatttcacgcaacttcacataagaagcatcgtagatgaaacgggaaatatcacgagaggtatagtgcatccaatagcgttcgggggtacaataacccaatacttgttgtcctgccagcccttctacgtcttcgtcataacggcaattaggaagaactacccctttaggacgtccccagtcaggataaatctgcccgtttgcggtcggtgtgttggcgttctgaggacgcatgaagccatatcgttcttcgtccgactcacccaaaatctttctggagaagaaatccgcgtcacgaccttccaatgacttgacggattgtccgtctacagaactctggatggatgtctgtgagaagaacttaccacccttctggaagtcgaacataacagagaaggagaaattacccaaacggaacacgttgttccagccacctcgccagtcagcctgtacacaacctaaatattcatagtcctgtccttctttcggcgacccgtcgagctgacaaaggatgtatccttcggcatcgcgtttaaatgtcttcgcatagatagcaccgtagggcttgcctacttccgcataagacttcacgttgtacacaccgctaccaatctgtatcttgtcgataccttcgggcaatgattctaccatggaattgttctttgaccagttgaaaatggttttccactcgaagttcttcaccttcaccggcacaccgctcacggagatttcccaacccttgttggagattttaccggagttgatgattacacgctggtaattggataaataagaaagttccgactcgacaatctgatcacgagtgtatttgtcatagtaagtaacatctgctgtcaggcgtccgtccagcaaacgaacttccgcaccgatttcttttgagatggttgtttccggtttcaagttcggattcttgcgtacggcgtcaccctggaaccacgccatgtcattacggaacaatcctccgtaactgtaactgttaatcaaacggtcgaaaccagcatcgttacccacgcgggcaatagatccgcgcaacttggcgaatgagaatgtcttgctcttcagcttggggaagatttccgtcaacacggcactggcactaccggaggcatagaagtaagaattgttagctttcggcaaagaacttgaccagtcgttacggaaagttccgtctacaaacaaaccatgatatcccaaagacaacataccgaatacggactgtttctctttcgcattcacactttccgttccactcaatatagaggcattgttggacaatgacttcacatccggagctgccagttgagaaacctgattccagagtttataccagtcattcttttgcatagaagtacccaagttagcactgaggctgaccttcttgatattgcggttataagaaataactccttcataattgtagttgttggaggcttcacggaaagtttcgtactgtccgtcgatatcccacatggtataataattgtcaaacttccaaccgttcttgtttgccttttctacactggcacgcaaacggatattcattccctgaatcggtttgatattaagagtcaggttaccacggaagttattacggccgtcaccattgctgatttcgttcagcagccagtaaggattgtagaatccgttaccacgcgtgaaggcttcacctgtctcgcgcttccacggcagtaattcctccataacgacgtcacgcggcatattcatgatggcacgcatcgggttacggttactgtcacctttataatcacggttatcggctgtttccagctgatagttaacggagatttcactggacagccatttagccagatccatattcacacgcaggtcaaatgtgtgacgcttcatgttatcaaagttcttcagcattccgtcgtagtcgatacccgtatagttgaaacggatacctgctccattgaacaccttattgaccgaaacactatgagtcatggctacacccatttcgtacatatccgtgataccatccttattaggtacataagaacgtatctgattattacgtcccaccagatcaaagcctaacatcggcagcccccatgagcgttggttcggattcgcccagttaaatacaaaaataccataaggcaggctggggtcataagcataaccgttctttgagttggaaccataatagttgaatccgtcacccacaccgacagccggaaggctggccgaaccataaacattctgataggcaggaaattcacgcaagaaagtaaactgcatattgtagccataagaaacaccgagtccggatttcttggtagctttacgggtagtgatcagaataacgccattggcagcatcagatccatacaaggcagccgcattggcacctttcaaaacttcgattgattcaatatcgtccgggctgatagcagaagcaggattaccatagtccaagtctccatcttctcccatcgggttcatgatgggcacaccgtcaattacgtacaacggctggttatttccggtcagggagttgttaccacgaatctccacacgggtagaagacaacggaccgccattcgaaataaaattaacgcccgaaactttaccgctcagactattcaataagttcgggtcacgtgtatccagcagagattccgtgtcaatggactgacgggcatatcccaacgatttggattcacgactgatgcccaatgccgtaaccacgacatcgttcagttctttgacatcctcacttagaacgatgcgcagcagatcattgtttttcaaggtagccagtctgatagtctttacagcatagcctatgaatcttacattcagaatagcatctttcggcacattgttcaaggtaaattgtccctccatatttgtcgcagtagctaagttttggtttccaaccaccgtaatattagcacctggaagcggatcaccaaactcgtcaacaacgactccagtgacctttcggttttgcgccgaaagtgaaagtgcgaagaacgtgagcaataccatcaggcacgtccctatcctccagcttcttttcagataaagtttctccatattagcttaagtttataattaataaatttgttcttttcatttttctacagtgatggtgaagtagttcaaatcaggtttgcccgccacaatgttcagcactgtacggcgccagccattcacatcgctcttcatggtgaaagcgtcgacagtaacccattcgcctccggttgcatgaagttctacgacaggcccttgtcttcttttcgtgccttcgccaaagtcaaaacggattttagcatcttctttggcagcataacataccttgactgtgatatctccggcagcataaggcagttctttccattccatccactcacccgcctctgtgctggtgacataccattcggtgttcttatccggagccacaccggctattttggcaacatccagacttccggtacggtattgattaccgctattcttagcagatacatcgaagaagtaatcgcaggcctccatttctacacggaatgattcggcccatgcccggctgctactgtatttacggagaatgttcagacgctggttggggaagtcatagtaaatgttgtcggtacttctccaataagcggcattctcggccatatcggtaaaaccttccaggaagaccagatcagcattcttcgcaaccatatcgtccaaagcatccgtcaaacgtttgccgtgatctgcatcaaaaaacatacgggtacccgatttatcattggtatagaaagccggaacagccacacctacagtttttccattgaaggtacgtaccgtccaggaactacgggtgggagcctgctcagaggcaataaaccaatcgttcagtgattctacgactgattcgtccacctctttatcacggtcctgaaaggctctgtcggcacaaataaagagatcttcgccataagcagacttgaagtcagcatgaatcttgttcagaatggcctttaatttgcctttacagtcaattttcttgttgcccaatgcagcatagtctacattaaggaaaccgttgatgctccacaaaaacaggacaggtttgccgtctatgcgaagaagatacttgttattggctttattctcgccataaaagttatcgaaggccagttttatattgtaatcccatatatacttatatatatcgtccaaattgtccagcggatacatcacctcttcatcggtcagtcccttgttttgctgagtttccgcactaatgaatgtagcataggtctgatacaagtcaaaattgcgggcagccgcccaggaagccggacagtcatcgaagatggcgatcttcagattttcttcattccgacgctgtaaagcagcaacgaagtctttgatacgggtaggatcgccatgatctctgtcataagcaggatcagtgtccgccttcggcaagcgtccgcggcaattgggagctacataatccaaaccactatacaccatctcttctaccaagttatcccaccactctgtttccgtagcaccaaaagacttcacttcgaaaagcggcttattataaaaggtagtagaactagtcccgccactggcagcatcttctccattgcggagattcttctgatagctgaacagcgcccccatcaaaaaactatgttcgggaatattactctctaccgcaggagcaggaagtatgaacgtcccttctgtcggtataaccgggtccggattagtatcaggaacaatagtattgtcctcatcagaacagctaacaatcatggaagctaatacaagccccatcgtgattttcaaataatttttcacggtctcttttttatattatacatttgctatttgttacacctcgaaaacaccctttttatctattatttaagaaagcgtcgactgaacaaacttaatatttaaggttatttttgagttctgatgcaaagtaacaagagcctgcttaagattttttataaaatacgattaaactctgattaatttctaattaattttaaaactaatactatcttcttataatttttcgcaatcttaggtattaatttcaggaaaagggggaagttttatatcactatacccccttttaatttatcgttctaaatcaatagattactttttatcacagcattccttcttttctgtgcaatcagctttcttatcgcaagcagtagcacaagagtctttcgcctggcagcaagagtcagttgcttcaacagcaacagcttctacagtttcaactgttgcttcttcaccttcagaagcggcagcgttattagctttgttaccagaacaagagatcacagcgaaagaaaatgttactgctacagcagccaaaaaaagttttgttttcataccttttaatttgctttaaacgtttaataaaataattgtcgtcggcaaatatagctattttttcctaaactgccaaaacaagaaatccccgccagtcaataaagactggcggggcttctctaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgaacacgtagtagtcgctacagataatggagtaatgtggatccttatccgaataataggatttactttgatctaatacaagtgagttttctcttaacaagaagaacttatacataacgtctttaaagaaatcattggattcaatgattctacgcagacgataattattagaagatgtttctgttactgatttaaagcctaattctacgtcagaaatagacaaagactgggatgatctgtcataccccagcgaacgagtcttaaatgaagaattagaattcgtatcggaagttgattcagacaactgacaagagcattcgctctgagaaatacatgaagtgatattcatagcatttccacctatgctatatgatagcatcagcagaacaatcgctaatatgaatctcacagaacctttcatgatatttattttagttgtttatatcgaattctcgtatttcggtgacaaatgtagcaattaaatatatccgtttgtcgttattcacatcatttaagcataaaagtttaactctattattgaaacaacgtacaaagtgttttgttctcgcagtttgtgattttatgtgttaaaagtagttaggcgtacatacgttttaaagaagtccgccaagtttaataattgagagaaatatgtataatcaataaatcctctccagtcttaaatccgaaagtatccaaaacaataaagcccttctggtatttctaccggaagggcttctctaaaaatggcggctacctactctcccactgttacgcagtaccatcggcgtgacgaggcttaacttctctgttcggaatgggaagaggtggaaccctcgtgctataaccacctgaatttcttcaattgacaatggacaattgacaaatgacaattatcgcagctgtcatgataagttatgacatgataaaaagtaaaattcaagtatctgttaatctaattgtcaattgtcaattgtcatttgtcaattgtcaattaaaaaagctaaacgtatatatcgcgatccgcaccgtccgaaagaaagtgaacgggcaattagtaatgctcggctttgatgttaccacctttacacctgcatcctatcaacgtcatcgtctttaacgaccctaagtcttacaggtatgatccagataataactggtcttatctcctaataaatcaactactttactcataactttatttttttaatgtataacaatttatatacaggcgatgaagcctgctattttttcttcccctgattggctaccgcttccatcagcttacgaatttcttccggattgcccaggaagtaatcattggcaacattcaggttctcgtcgaactcgaatacataaggaacggcagtaggaagattcagtttgatgatatcttcatcagaaatatgtttcaaatgcttaatgatacctcgcagactattgccatgcgcgacaaccagcaaggtatgcgcatcttttaaagccgggaatatatccgactcccagtacggcataatacggtcgatggtatcttttaatgattcggtacgcggcagttccgcatcggatacttcgtgatagcgataatcgaaacgcggatttctcaaatcgctttcggaaagcggattgggagctatatcataactgcgacgccagatcagcacttgttcttctccgtatttctcggctgtttccgccttattgagtccttgcaaatcgccgtaatgcttctcattcagacgccagctcttctcgacgggaatccagtccagattcattttatcaagcacgcagttcaaggttttgactgcccttttcagataagaagtataggctttatcaaagttgaagccatattccctcaacgtgacgcctgccttttccgcttcggcaactcccttttccgtcaggtctacatccgtccaacctgtgaaacggttttctttgttccaagcactctctccatgacgaagtaatactatctttttcattcttaatggtctcctttcttctttttatatatacaacattttgtttctctacaaagttcacgaaagaatcagcaggtatcaatacctaaaagtgatggtttattgaaaagaattcaatagaaatgactatttttacggactaaatgaatattcaaccgccaacttaaaacaagtcagacattggaaacaagcaaacagaaagaatacacattcctgcaaaaactgctgaataaagcgaatatgggatggtgggaagcggacttaaaaacagaaagttatgtatgttccgagtttatctcccgattactcgggatagacgaagacggagtgatcagttttgaagatttcaataaacgtatcctaagggaggatcagcaccatactaccagctactctttcgataaattgcaacagagcattgaggaggtgtacctgctcgatactccccacggggaagtatggattcgcagtaaaatatgctttcaggaaactgatggggaaggaaacaccaaaatatacggaatagcagaaactcaagatggtccacgcatggcttccgcctatcaggcactgcaaaacagtgaacgtatcctgcacaatatctataaaaaccttcccgtcggcattgaactgtataataaagacggttatctgcttgacttgaataaaaaggaactggaaatgttccatatcacccataaagaaaaagttattggtatcaatatctttgagaatccggcactacccgaagaaataaagctaaagatcagagataatgaagaggttgaattcaccttccaatatgatttttcaaaaatcaaaggatattatgaatcggaaaaaacatccggtttcattaatctgacaacaagaataacaacactttatgatcatgaccggcagcccatcaattatctgttgataaacgtagataagacggaaaacaccatcgcctacaacaaaattcaggaatttaaaaatttctttgaactggtaggagattatgccaaggttggatacgctcattttgatgcgttaagccgcaatggttatgccttaagcagctggtataaaaatgtaggagaagaggaaggcacgcccctaccggaaattatcggtatccattctcactttcatccggaggaccgggctgttatgctcgactttctggcgaaagtggtcaaaggcgaaagtacgaaattatgcagggatgtacgtatccgcagagccgacggaagttatacgtggacacgggtgaatgtgttggtccgcaactaccgaccgcaggataatgtcatcgaaatgctgtgtatcaactttgatattacccaactaaaagaaaccgaacaaatgcttatcaaagccaaagagaaagccgaagaagcggatcgtttaaaatcggccttccttgccaacatgagtcacgagatacgtactccgctcaatgcgatcgtcggtttctcaagtatgctggaagaggcggaggatcaggaagaaaagcatcagtatatcacgatcatagaagataataacaagttgttgcttcagctcatttccgatatcctcgacttatcgaaaatcgaagcgggaactttcgacattattcctgaaagagtaaatgcgaaacagctttgtaacgatctgtttcaggctatgcaaatgaaaactagtccacaagtagaactccgcctgaaagataatttacccgaactgacgttcaccagtgacaagaacagactttatcaggtattactgaactttgtgactaacgcactaaaattcacttccgaaggaaatatcaccatcgactaccaaatagacggaaacgaagtgaaattctccgttcaggacacgggaatggggatagagccggaaaaacaggaagctatcttcacccgatttgtaaaactcaacagttttattcccggtacgggactcggactgcctatctgccaaagtatcgtcacgcaactgggagggaaaatcggtgtggaatcggaaccgggaagaggggcttgcttttggttcacccatccaattaattaaagaaaaatctcttttaaattgctctgtcatccctcactaagttcggaatggcagagctaaacattatttttcagacaacagtccattttcatcggtttctcttcaggaaaatacggtctgtaatagtgcccggcaactctgattcgtagtgagtcaccataatcatcgtcttgtctttgcgatggcagaaagcctcaataatcttctttacccgacgacggttgtaagtatccagaccgtgaagcggttcatccagaatcagcagctccgggtccttcacaaaagcacgtgccagcaatgccagccgttgttctccactggaaagttgcaaaaaagggttgtctttcaattccgcaataccaaatatatccatccaccattcgcagatggccatttgttccggctggggacgtttgtaaagcccgatgctgtcatgaagcccactggccacgatttcaatagccggcagatttttgagataagcacgatgcatctccggacttacatagccaatatgctttttaatttcccaaatactctcccctgtaccccgcttccgcccgaaaaggctgatgtcacaagcatatgattgcggattatccgcacagacaaggcttaacaaagtagattttccggccccgttttcaccgctcaatgcccatttctcaccacgccgcaccgtccagtcgagatctttcagaatagtgcggtcatcatagcgaatgctgactttattcagtttgaccacttcatcagaatcgtaattattgccatcatagggcaaattgacgatacgctgctgtaactcatcaaaagaaacggctgcatctctggaacgaaaagcttccagataggcctcacgttccattttggggtacaccgtcattttatccacaggaattacatgggtaataaatgaaggaatatcatccagcattgacaataccagaataatctgtacggacgacatttttgtcaagcgatcgagtaaagaaaacagcaactcgcgggtaggtgcatccagaccaataaacggattgtccataatcaatacacggggagctgtcagcagagttttgaccagctggaatttacgcagttcgccactggagagaagaattattttcttatcgagcatcggctcaatgcgaaaaagctcaaacagttcttgtttcagttgttcgtccttaatttctcccagcatttcacgaacatcgggtgcttcgtcctgatcgtgggcgttccagcgttgctgatagtaataattagcatcggcagccccgtaagtgtcacggaaagcgatgtacttcacattatcatagacggtctgggtggcagcaggagaaaagtcatattgcagcgtcccttcacgcaatgggtatttaccgatcagcgtatcgacaaaaagactttttcctcctccgttgggacctacaatcgcaatgtgttctccggctgaaatcgttgccgtgatgggagcagctaaacgcacaagcgggttgcgtgctacgccccccgctatgttgaatgtattttgaatcatattcttctattctgtttgattatcaaaagactgaatttacttatataaaatcaaagccgactgactgggaataataacttccggcccgttttgtatgcctaatccacgtacatctatcactccgtctttacataccactgtatatttaccaaccggaatagtaagcctggcaggagtaggacgagaattaaatgcgacgatgatatcttcccaatgatctccatttgcatggtctttcagacggaaagcaatcaggttgcttccttccacaggaagaaattccagatgttttcgaacctgtcctgcatctcccatgcggaaggccggatgagatttacgcagatcgatcaatcgtttataatacatgaaaacatctgcgctggtggttttgcgccgccagtcgatggcattcactgcatccgggctcttataactattgtccacgccttgcttatcacgcatgatttcttctccggcgtaaataaacggaataccttgtgaagtaaagaccacagtctgtgccagtttatcgagacgtataagttgttcgggagtgatgtccggcatgcttgccttcagtcggtctaccaaacacagcccgtcgtgacaggaaacataactgatcatttgcacaggctgtttcgcccacggcttttgagtataattaaccgaatcgcactgtacttgcggatgctcgatagcgcctgctatgccgaactttacgctcatctcccctcccggaattccggcaagaaaagctcctttgcgcttatcgcctacaggtccgcaaagcccgtcacgcagctcgtcagaaaagacagcaactccgggtatctgtgctatatttcccttcattgccaaggagtcagccggatactgaggcgcctcggcagcccacccctctccgtaaatgcaaatggtaggatcgaccgcatttacagccttccgtatctcgttcatcgtttctatgtcatgaattcccatcaagtcgaaccggaagccgtcaacatgatattcttttatccaataaaggacggattctaccataaacttacgcatcataaggcgttcgctggcagtctcgttaccacagcctgagccatttgccaaggttttatcttctttctggcgatagaaataaccgggaacggtgcgctcgaagttactctcatcggtattgaatgtatgattgtacaccacatccattatcacacggataccagctttgtgcagtgcctgtaccatctgcttgaattctttcacacgagtggcgggctgatagggatcagtggcataggaaccatcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatacctgtcagtaacttgtcggagttcatcgttccatgttcggtcagtgccagatattttcctttattcttcactcctgaagtagaatcgaccgaaaagtcacggtggtgcatctcataaataatcatatcggcgggagacttcaaaggaggtcgggtgtcactctcccaaccgtccggattggtggattgccagtcgataatagcggcccgcttcccgtttactccgacagcacgggcgtttattccgggagtatctccctgccacttgtcatcgatcttcacattgaaagtatagaacttgccaataaggtccttacttaccacagctgtccaggttccttcttcccccgactgcatctttaccgtttcataggcatgtccgccctcgcctgcctcataaagcatcagacgtacttcatctgccgtaggcgaccaaagagtaaacttcgttgcctccggtgtatactccatttcaatcagacttcctgtacggaccggatataattcataagacatatattcctttttcgcagtagtacaactcattactgtcgtcaccgtagtcacccctaatatcgctaaataattggttcccattttcatactaaacctcccctgcggtactcacactaccttcgcacttacttgtttattacttttctcactcccagcctctttcattgcgggtttattttactttatcgggatttttcgcaataaaatctttccaactgctatatcctttttccattgccggacgtcccatttgcagaaaatgacaataggctgccgccaaaccgtccgtcgcatccataaaggtaggcatctcttctttgggaaaatgcagcatacgctgcagcatatccgctacttgttcctttgatgcctgtccgtttccggttatagccatcttgatcttcaaaggagcatattctgtgatcggaatatcacggctcaatgccactgccatcgccactccctgagcacgtcccaacttcaacatggactgtacgttcttgccgaaaaaaggagcttcgatagccagttcgtcaggcagatagctttcgatgatacttaatacccgttcgtgaatatgccgcagcttcagataatgattggcaaatttacgtaaatcgataattcccatcgcgatcatctcaggcttagtccctttcacgcgcaagactccatatcccatgatggtcgtaccggggtctatacccaaaataatcttttcttttaccggttgaatcactctactatctccatcaatgtcggaaaaccgactactttatccttgaatattttcgtaagttcgtcattcagccgcactccctgttccatgtgccagcgatgcagcaatccactactctctacttcccattgcagagaataagaacttccgtcgtcccgatggctcagtatccgacagatacgcggtgctttcaacgtcccgtgtttctgtacttcaggtatatagctttcctttatccaaatcaaaaaattatcgtgaacagcatcgtccacctgaaaagttgtattataaatcagcatatcatctgtcctttcaataaattattttccgcaaacatagcaattatttcagaatattccattatatttgcgccaacaaaagcaaaacgttgacaaacgttatatcagtggcataaaaatggggcgttagctcatctggctagagcgcgacactggcagtgtcgaggtgatcggttcgagtccgatacgctccacaaaatgaaaagagtaacttatgataagttactcttttttttattttaaacctgtgattggctttgtagccaagcttcattaagacatttatattaccccgaaatgtttcaaagccttgtaaagtccactattgtccaccgtatcagtgacaaagtcggcaactgactgaactttttcggacgcatttcccatcgccactcctattccggcggccttcagcatggggatatcattaccgccatcaccgcacgccattatttcagaaactttaaccctgtagtaatcggcaaataacgagaggccggttgccttacttgtccctgcaacattaacatcagcaaataaaggatgccagcgtgttgcggaaagaccagacagaagcggcattactttttgttctgcttcctcatcaaaataaaaacaaagttgacagcattcttttctttcaaacatctcttcgatgtcgacaaccggcggaaccggatgctcaacaattccggcaatctgttcgacagtcggggtaaggcgattgacaaatacaccttcatttaattcgagagcgactgcaaaatcaaattcccgtgcaagctccattgattttctaaaatcctgtgcaggtattgctacttttcttatcacacttccgtcacgcaatacacactctgctccattaagtgcaataactccatcatacggcacagcatcaatctcatgaagatcacttgccgctctaccggtagcaatcacaatcttaattccactatcatgtacttttttaagagcatctatagaggattgcgacaccttatgagtttcaaaactcaacaaagttccatctacatcaagcaataatacctttatcatactatctatatttttgggctacaaagttactgaaaagtttctcatggcctacaacgataagcacgagatcgtgttaaaaaagatatcatatatacaataaaaaaggacctttattcaaggtccttttttatcacttcatccatttcttttattcgtttctcacgatccttgatgggaccgtctttcgtatcacctttgaatacattatctgcacgatcggtaacttcagtgctccattcttcaaactcattcttagccggacggccattcggttcgatattttcctcagcaatcgaatcgtgtctgttaatcatatcatccatatcttctctttttttattggttacaatgataatacaatataaaaagagaaaagttccgggcgttaatgttttttggacaactcgcgttcgcgtatctgcaactgttctttatacaactggggacggaaagggacataaagggtataatcactttcaaccgccttgcctcccaccagtgccggtgtccaatttggcatttccttcacaatgcgaagagcttcttctgcaaactccggatgagtcgattttaatatatgaggacgaagaatcactccctccttatctatagtaaactcacacaaagcatatcccgagacattgtctttaagcaattccgcaggataaatcatttgtccggctacatattcccgtacacaaacatcagccaagcagggtaattcttcaatttgctttcccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgttttgagcttcggaccaacagaataaatccccacatacatcggctttttgtgagcgtccggctgttctttggtacggtgctccagctctttcaataaagcggttgcttcctccgccaatgcttgttccgaaatattttctccctgagaaaacatgtaagtcgactgacaaaccaacacaagccgctccatcaaagtacctttcatgggtgaccacttccgtcccatcatctcttttcctttcgcatctgtcgatgagaagtaataaacaactccatccagtccggctgtcgaaccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatcctgtatctggctggttaccagacgggcgatagctcccaaagactggtataaggactgactgatctccactgatttagtttccactttcaccgttcctttctctgcctgccaataggtacgcgacaaagtattcgcaatcaacagacaacgtccgttcttcttctctaccgacattgcatattccggtgaaaaagaaggaatggctacaaaacgcgcgtaaggacgctgttgaaaacctgtattaagcaaagaaaagacatttcgataatactcacccaactcacccgtataggtagtaaaaggcttcaccggctccagatagtcgatctgagctgacaggcgaaacgataaagtcaatagcagaagagaaataacaatctttttcataagtgttccccgattttcggtacattcggcaacaaagatacaaattatttcgatggttcgtgataaaattatatctttgcacggtttttactaagaaactgaataacaatacatcaaaaatatgatagctaagattgaacaacttctgaaagaggtggaagctttgcacgcctccaatgccgaagaactcgaagctctccgcatcaaatacctgagtaagaagggagccattaacgatttgatggcggatttccgtaacgtagctgccgaacagaaaaaagaagtcggcatgagactgaatgaactgaaaactaaagcgcaggacaaaatcaatgcgttgaaggaacagttcgagagccaggataatagttgcgacggtcttgacctgacccgctcggcttatccgattgaactcggtacacgtcatccgattacaattgtaaagaacgaagtcattgatatcttcgcacgtctgggattcagcatcgccgaaggtccggaaatcgaagacgactggcatgtattctcggcactgaactttgccgaagatcatccggcacgcgatatgcaggacacatttttcatcgaagctcatccggatgtagtactccgtactcatacttcttccgtacagacccgtgtgatggaaacttccaaacctcctatccgcatcatctgtccgggacgtgtataccgtaacgaagctatcagctaccgtgcacactgtttcttccatcaggtagaagcgttgtatgtagacaaaaacgtatcattcaccgacttgaaacaggtattgctgctcttcgccaaagaaatgttcggcacagacaccaaaatccgtctgcgtccgtcttatttcccatttacagaaccaagtgctgaaatggatatcagctgtaacatttgcggtggtaaaggttgtccgttctgcaagcataccggttgggtggaaatcctcggttgcggtatggtagacccgaacgtactcgaatcaaacggcatcgacagcaaagtatacagcggttatgctctcggaatgggtatcgaacgcatcacgaacctgaaatatcaggtgaaagacctccgtatgttctccgaaaatgatacacgcttcttaaaagaattcgaagcggcatattaaatagagcacagaatttaccagtatgccaatgtgccaataaaaccatctgatggtaattgggacattggcatttaatcaatataccgattacactgaaacgggatggcttatcaccgttccgatcagcaaattgaacgttcacttattatggcaaaggatagactcattactcccggttattgtttcatcttggcagccaacttcctgctctacttcggtttctggttgctgattcctgttttgccgttctatttatccgagttctttcaggcaggaaattccactatcggcatcgtgctttcctgttatacggtagctgcactctgcatccgtccgttttccggctatctgctggatacgtttgcccgtaagccgctttatcttttcgcttatttcatctttatgctgatgtttgcgggatatcttatcgccggctcgcttaccctatttattatattccgaattattcatggagtctctttcggcatggtcacagtaggtggaaatacagtagtcattgacattatgccctcttcccgcagaggtgaagggctgggctattatggactgaccaataatatcgccatgtccatcggaccgatgttcggactgtttttacatgacggaggggtttctttcgctacaatattctgctatgcgctcggttcctgtatgctgggattcctgtccgcaagcctggtgaaaacaccttataaaccaccggtaaagcgtgaaccgatttcactcgaccgtttcattttattaaaaggaatgcctgcgggactcagcctgttgctactctccatcccctacggaatgaccaccaattatgtagccatgtatgcccgcgaaataggaatccatacacaaacaggtttcttttttacctttatggcgatcggtatggccatttcccgtatattctcaggaaagctggtggaccggggaaagataacccaagtaattgccgccggactcaatctggttataataagtttcttcctgctcgcatcctgtgtatatctgattcaatggaatgatgctgcctgcaccattctctttttcggaattgccctgctgatgggaatcggattcggaattatgtttccggcattcaatactctgttcgtaaaccttgcccccaacaaccaacggggaacagctacttccacctacctgacctcatgggatgtaggaattggtatcggtatgctgaccggaggatatatagccgaaatctgttcgtttgacaaagcatatcttttcggtgcctgcctgacagtagtttccgctgtctatttcaaattaaaagtaacgcctcactaccataaaaacaagttaagatgagaaagaaagaacgttatgaaaaagtaatcgcatggtttcaggcaaatgttcctgtagccgaaacagaattacattacaataatccgtatgaattactgatcgctgtaatcctttctgcacaatgtacggataaacgagtaaatatgatcactccgcctctctacaaggacttcccgactccggaagctcttgctgccagtacgcctgaagttattttcgaatacatccggagcgtatcttatccgaataacaaagccaaacatctggtaggaatggctaaaatgctggttaatgacttcaacagcaaagtgcccgacaacatggatgacctgatcaaacttcccggtgtaggaagaaagaccgccaatgtgattcagtccgtcgttttcaacaaagcagcgatggcggttgatacccacgttttccgtgtcagtcaccgcatcggactggtgccggacagttgtacgactccattcagcgtagagaaagaactggtgaagaacattccggaaaaattaatacccatagcccatcactggcttattctgcatggtcgttatgtttgtcaggcacgtacgccgaaatgtgacacctgcggtttgcaaatgatgtgcaaatatttctgtaacacttataaagttacaaaagaggcaccaaaagccaagaataaataacgatttaatagcaaggaaccgaaataaatagtaactttgcggtcgatcaaaaaagagaatattaaaaacacttttaaataaaaatagagtattatgcagacaattgacaaattcaattttgccggtaaaaaggcatttgttcgcgtggacttcaatgtacccctggacgaaaacttcaacattacagatgacactcgtatgcgtgcagctcttcctactttgaagaagattttggctgacggcggtagcatcatcatcggttctcacctgggccgtccgaaaggcgttgccgacaaattctctttgaaacatatcatcaaacatctgtctgaactgctgggcgttgaagttcagtttgctaacgactgcatgggcgaagaagccgctgtaaaagctgctgctctgcaaccgggagaagttctgttgctcgaaaaccttcgcttctatgctgaggaagaaggcaaaccaagaggtttggctgaagatgccacagacgaagaaaaggctgctgcaaagaaggctgtcaaagaaagccagaaagaattcaccaagaaattggcttcttacgctgactgctacgtaaacgacgcattcggtacagctcaccgtgcacacgcttctacagctctgatcgctaaatacttcgacactgacaacaagatgttcggttacctgatggagaaagaagtaaaagctgttgataaagtattgaacgacatccaacgtccgttcactgctatcatgggtggttctaaagtttcttctaaaatcgaaatcatcgaaaacctgttgaataaggtagacaacctgatcatcgcaggtggtatgacttatacattcaccaaagcaatgggtggtaaaatcggtatctctatctgtgaggacgacaaacttgacctggctttggatctgatcaagaaagcaaaagaaaagggtgtaaaccttgtactggctgttgacgctaagatcgctgacgctttctctaacgacgctaacactcagttctgcgctgttgatgaaattcctgacggatgggaaggtcttgacatcggtcctaagactgaagaaatcttcgctaacgtaatcaaagaatccaaaactattctttggaacggtcctacaggtgtattcgaatttgaaaacttcactcacggttcacgtacagtaggtgaagctatcgttgaagcaactaagaacggtgcattctcacttgtggggggtggtgactctgtagcttgtgttaacaagttcggtctggctagcggcgtatcttatgtttctacaggtggtggcgcattgctcgaagcaatcgaaggaaaagttcttccgggtatcgctgccattaatgaataatgaatttataacaatgtaattttagatacgagggcagttctttgtgaaaagagttgcccttatttatatctgacccatcaactaaggcatgaagagagcagcactcatattctgtatcctccttttcttcctttattcttgccaaagaaaaaaaggagaaagcgtctttataccttcaacagaattacaaccactcacactgggaatgctcccgactctggacggactgccttttcacatagctaaagcacaaggaatctacgattcgctgggattggatttgaccatcctttctttcaattccgcctatgaccgcgacgcagcgttccagttcaaatcaatggatggcatgatcaccgactatcccagtgcagtaactctacaggctatccaccataccgacttaggaatcattttgaaacatgacggttatttctgttttatagtctccaaagaaagcggtatcaaccaacttcaggaactcaaagaaaaaaatatagctgtttcacataatacgattatcgagtatgcaaccggacagctactgaacaaagcgggaatcagtcaggcagaagtgaacaaaccggaaatcgcccagctccctcttcgcctgcaaatgctgcaatacgatcagattgacgcatccttcctccccgaccctgccgcatccatcgcaatgaatgcccgtcaccggtctctgatcagcacacaggaattgggaattgatttcactgtcaccgctttctcccgagaagccatcaacgaaaaaagaagagaaatcgaactattaatcaccggatataatctgggaatagactatataaaaatgcacccgcaaaaagaatggaaacaggtattgatagagatcggcgttccggaaaacctgaccggcctcattgcactccctgtttacagaaaagcggagcgcccctcagccgatgccctggataaagctgtaacatggctgaaaacaaacaaccggatacctcagacatattccggatacaaaagtctgatagatacaacttttataaaaacaaattcaactactatcaaataacaactaatcatatgcgaaaaacactctttcgactctcaatgatcgcgttcgccctgcttggtatgcagagtacgctcaccgcacaggagaaaacaccgttgaatcaagtagtcaatacactgaaagaaagaatcagtctggccggttatgcacaactgggctatacatacgacgatgccgccgatcccgacaatacattcgacatcaaacggatcatctttatggcacatggtaaaatcaccgacagatggacatgcgatttcatgtatgatttctacaacggtggtatgctgctcgaagtatatacagactaccggatcctttccggacttacagcacgtatcggagaattcaaagttccttataccattgaaaacgaactgtctcccactacggtggagctgatcaactgctattctcagtcagtctgttatctggcgggagtcagcggcagtgacaaatgttatggaatgacttccggacgagacatcggtatgatgattcacggaaaattatttcatgatttcctccaatacaaatttgctgtcatgaacggacagggcttaaacaccaaagacaaaaacagtcagaaagatgtagtcggcaatctgatggtgtatcctaacaaatggctgtccgtagggggatctttcattcggggaaccggacacgccataggtgactcccaatattcgggaatcaaagcaggagaaaattacgccaagaaacgcttgagcctgggaggggttgttactacttccgcattcaacttccgtacggaatatcttgcaggaaaagacagaaacgtaaaaagcgaaggattctatgcgacaggcagcgtacgtttattacaaaatttcgactttatcgcctctttcgattatttcaatccgaacaaagcggcagatttcaaacaaaataattacattgccggactgcaatactggttttatcccagatgccgtgtgcaggcacaatacactttttgtgataaaaaaggagacggacaaaaggattctaatctgatacaagcacaggtgcaagtcagattctaactttttggcatcctttttgttctattacctataaataattgaaccattatgaacgaaaaaacgattaatgaacaatacgcctatatacgcactctgcttgaagaaaaaagacttaaagaagctctgatgcagttggaatccctgctctggcaatgtccggactgggatttacgtacccgcttggagcaactgcaaacctcctacaagtatatgctggagtatatgcgccaaggtgcaaacgacccagaacgctggaatgtatacagaaaactcatagctgatacctgggaaatagccgaccgttcgcgcctgcttatgctggacaatgcttcatcaagatattatcatgaggtacgccgcactccccgaccggaaagtctgtcagcatatacactcaaaaaattactgcacatgctggagtcattcaatgacgacttggcagtcagcggactgttgtctgacgaaaagatggacgaggtactgaaacggcatgaagaaacacttaaatatatgtttctgcaaacatggaccaacagtgcatggactcccgaagaggaagaggatgcacaatccatgcttacctccgaacttcttccggtgaacgacctgtgcctgtttatcagtgccgtcacattaagtctgatggaatgctttgacctgcgtaaaatcatgtggctgctggacgcttaccgccatccggatgtcaatgccggtcaacgtgcactggtaggtgtcattttcattttccatatctacaagaaccgtctttcactctacaatgatctggtcaagagagtcgacctcatggatgagatttctccattcaaagaggatgtggcacgtatctatcaccaaatgttactatgccaggaaacggaaaagatagacaagaaaatgagagaggaaatcattcccgaaatgttgaagaatgtttcgtccatgcggaacatgagattcggctttgaggagaatgaggatgagaacgatgacaagaatccggattgggcggacgctttcgaacaatcaggactgggagacaagttgcgcgaaatgaatgaactgcaactggaaggagccgacgtatacatgagtacatttgcggcactgaaaagttatccgttcttccgggaagtacagaattggttttacccgttcagcaagcagcaatccgatgtcatcaagcaactgaaacaggaaggtaacgagaaaaacacattgctggatttaattcttcaatcgggatttttcagtaacagtgacaagtactcactcttctttacgatccggcagttgccaaaggcgcagcaagacatgatgctaagccagctcggtgaacaacaagtggcagaactgaccgagaagtcgagtgcggaaacaatgaagaaattcaatgagcgaccgggaaccgtcagcaatcaatatctgcatgacctgtaccgtttcttcaagctcagtgtacgccgccatgagtttagggacatctttaaggaaaaactcgatttacaccacattcctgcacttagtaacgtattatatagtgaagatatcctattcccgatcgcagatttctatttaaagaaagaacgctggaatgaggcaatagaagtgtacgaggaaatggaaacgatcggagcacttcaggaaagaggtgcggaatattatcagaaactgggatatgccctgcaaaaaagcaagaagtatgcagaagcgatcggtgcttatctgaaagcggatacactgaaaccggataacatctggaacaaccgccatctggctatctgttaccggttaaaccgaaattatcaggctgcattgagctattataaaaaggtggaagaagctacaccggaagataccaatgttattttccatatcggcagttgcctggccgaactcggacaatacgaagaagctgccaactactttttcaaactggatttcatcgaaagtaattgcataaaagcatggcgtggcatcgggtggtgttcattcatcagccggaaatacgaacaagccatgaaatattacgaaaagatcatcgaacagaagccactggctatcgactatatgaatgccggacacgtcgcatggacaatgggagacattcagaaagcggccgccctgtacggcaagtcaatcacagccaacggaaaccgcgaacgctttctggagatgttccggaaagacgaggaagctcttctcaaacaaggtattcaagaagaggacatcccgttaatgctggatttattataacttcttcagctccccgtacagtttctgtatggggagtcccattatattataaaagctgcccgaaatagactttacccctatatatccgatccattcctgcactccatacgctcccgctttatccataggctgatatttgtccacataataccggatttcctcttcggacaaaacatcaaattccacatcggatgcagcagtaaagctcttttgccattcagtggtcgtaagacaaacaccggtgaacacctgatgtgacttaccggacaaagaacggagcatttcgaccgctccttcgcgaccttccggctttccaagcactttaccatcgagccagacaatcgtatctgccgtaatcaacagttcccccggttgcataatactccggtaagcatccgccttttcgcgggagatatattccggaatctcagcaccagccagatcggctggatatgattcatccacatccggcaatgtcctgaccacataatccactcccaaacctgacatcagttctttccggcggggagaattggaggctaatataatctgatatttatctaaatttccaagcataattttatttattattaagtgatttacaactcaccagccgaaagcatcttccgccatccacttgccatgagctttcaatacttgttccaccacatcacgtccacagccacgaccgccatcggcataagatatatacttcgcgaccgacttaacttccggaacagcatctttgggacaacaaggcaacccgcactcacgcatcacttctatatcaggcacatcatcgcccatatacagaatttcgtcatcagacagaccgtatttatcgcggaaattacggtaatcatgaattttcactgcagaccccatatacagatccttcacacccaatgctgcaaaccggatacgtaccgcttctgtccgtccaccggtaatgatagcaatatggagtcctttctttactgccaactgaatggcataaccgtctttaatattcaccgtacgcatcggttctccggaaggatgcaacgggactgttgtcgaactcaatactccgtcaacatcaaaagccagtgctttgatgcgggatagatcataattgatggtgctcatggatacttttactcattaatttataaatttcctgcaatgcctgactgtctgccagcatagaaagatgcttattcatcacattctcgtcatagcgtacagccggtccggtctgcgcatcacgaggagcaagttcatgcactttgcgtgccgtttcgtcaatcaggggaagcataacatcaaatggcaaatgatatttttccagcaattcggcggcaagagcatacatatggttggtaaagttacaggtaaagacagctgccagatgaagactcctgcgttgctccgaatcggcttcgtacaccttatcagagagtgtaccggcaaccgctttcagcagctcggtatcttccggtctttttgcttcaataaagaaaggtacttcccgaaaatcaacttcacgttgtttgctgaacgtctgcatcggataaaatactccgtagcgttccgcatgaccttcccaaatattcatcgggatgctgcctgccgtatgcaccaacagcgcatgctgcttcccatcagtgatctgaggcaacagttcgacgaaagcggcatctttcaatgaaataatatataatctcgcttcattcgatacgtcttttaaatcagtgatatattccgcttccacttcattggctaacgtacgagccgattcttccgttcggctgtacacctgcatgatacggaatcctttccggtaaagcgctttcgccagattagttgccagatttccggcaccgagaaacacaacgggcgtatcttcaatacttcttttcattgtttctttaacgttttgaaacccaaaataaaataattccgatgatcaacagtgccaatggcaacagataaccggacaaggaaccgagcaatgacattaccagaccgatattcattaccagccacagtcccaacagcacaaagccgaccgacttgtcacgcttgaaaataagaaaactgatagaggcatacaacaacaaattgtccttattcatcacccaaggcaaacctatagaagcaaaggggagcagtttatttatcaggaaaagagttccgataacaataaaagcgacggcagtagccttataagtatctttattattatttgctttgacagctcccatcgttattttcctccgaacttattaatatgaattttctcccactggaggtgttcttcgttgaaaggcttacgttccattcccttatgtccgatggcaatcacggaaagaatctgcagttgcaaaggaatatccaaaattccatgaacaaactcgtcagacggcattccggttgcagtgaaacgttcgcgaacctgtacccaacagcttcccagccccaaatcttccgcctgcaactgtatcatgatggaagcaatagaagcatcttcaatccacacatcgcttgccaacggatcagccatcacaacaatcgccaaagcagcatccgcaatgaacgaggaagcctgctctttgcagtgagacagttctttcaacttttctttatcatcgactaccacaaactgccagctattactacgtttggaactgggagacatcaaggcagctttcatcagtgccacaacctcatcctgtgttaactcctcatccgtaaatttgcgcatactgcggcgattctttatcagttcactgaaattttccatattatttccgttttcatttgatttatgtatgcaaagatagcgcaaaccgatcgtaataagaaatgaaattgtatctttgcactgagaaatatattcattatgaaaaaacgaattacacaagacgattacatcaaagcgaatcgtaaagccagccgtgaggcagaaatcaaagagcacggacaccccgtttgttacaaacgagtgcatgagtcaaagaaagtatataaccgcagaaagataaaggcagccgataaaaagctgccttatttttttcatttgggatagtgtcggtatcccaatgacatagtgacaccatgagacagtgatagtgacactatcctgttgcgatagtgacaccatgttttatgcagttcctgataggcagaaagggcgatttcctatacaattcgcgtcagttctccagtagtggagtctatgataaacccgtgcactttcacgtccgacggaatcaaaggatgatgaactataaaatcgaccgttccccttaccgacttctccgtatcttcaaagccatctagccaagaatgaaaatcgactccacaaaaactcatcatatgaatataatcggcattaataccccgtgccttcatcttctcaagcatttcttcactgtgcatatggcaggctccacaatcagaatgggcaatcaccattatttcctccacacctaactcgaagatagcgacaagcagactgcgaatcacactaccgaaaggatgggaaatgacgcctcctgcattcttgatcattttaacgtctccgttcttaatgcctagtgcggccgggagtaaagctgtcagacgtgtatccatacaggataagatagcaatctttttatcgggatacttattcgttatatattctttatatccctcgttcttaacgaactctctgttataagcaagcatttcttctatcatagcgctattttgtttggacacacaaaaataaagaaaataataaaaagctgtatcaggaaacaatgaaaatataccggaaatcctttttaaacttttacgcaggatacaggtatggaaacaaagagccggacaagagaaatctcctgcccggctcctattaattatgcttgattattaattaactgattaataaccggcgttttgtccgaattctgccggattattgatcgcatccagatatttcgtaggaataggacgcaaatagaattctttcttaaagtgctcagcagcacgcttattataagcagccaaacgagtctcaaaagcagcattacgtttcagcaaataccagcgggcacattcgccacaaagttcacgggcatattcatcgaaaatataattcagatccacttgcgactcactgaccgtaccggcaccggcacgcgtacggagtacattaatatatttggcagcatctcccttgttcaagcgtaccgatgcttcagcagcaatcaggtaaacttccgccatacgcatgatcatcacatccacagtttttctctgaacgtctctgccgacaaacttattacccggcatattgaatttagaaagagccggataaatagataaccacaaagcactggcagcactaggcttgtcataggtagccctggctgttccattctcatcgtaaagatcgaaaacattaagaaccaaccccggatattgagctttttcctcttctgtcagcgtcttcaaagaacaataaacggcatattgatgagcttctgccggatctaaaggcatagcaggatgaagaatattaccatctgttttatcctgagtagtcttcgctgttccatctgcattccagatagccagctggcagtaattagcatcggctgtactattggattccaagttaaaatgaggataaactttcttacctatattagatgcgggaataccaaatttagtagcaagtgtgcttgtgatttctttggcacacgctgaacctccatattcataagtcgccccccatgccggtatagaataagacgagtaagctgaaataaatgaataacgaaaacgagagtcgttcatatcagcagcaaaacagtccatcagatatttggatggcaggaagatattactgttcggacgaccgtaaacgaagtttgaagtcttgtctaccaaacccagatccgtatatgttcccaacgaaggtaagaagtgacggaacatttcactttgtgagtagttaccattggtgtaagcgtccgaatttctttcggcacccgcagcaatgaacagagcttcttcattgttacgattattattttcgttgaatacatcggcaaaagcaggatgcatataccactcataaatcgctttattattaatcatggttgtcgccgtatcataggctttttccagaaagctgacaccatcggtatctttcagatcataaccggcaccattaatatatgcacgtgccaataatcccatcgccgatttctttgtaacgcggctatagtaatcactgaaacttacaggcagattctctacggcaaacttcaggtcttcgataatggcagcataaatttcgggaacggtagaacggtgagcatcaaaagaaatattctcgctatcggcagccttcaactgcaaatcgacatttccaaactgctccaccagattcatataatagtaagcacgcagacatctggcctgtgccacacattcattaatttcagtctcatcccctgtcacattctcagctccgtcaatcacaatattacagctgttgatacacagataagaatattgccacactttataataatagctatcatcggttttcataccgttataactatgataacgctgatagctggagcccgatttaggttcttcccaaatatcagtacccgcttccgtacaaaccagatagtcactactctgatagatgttgttgatcaaggctgtatagcacgagttggtgaatgccttataagtttccaatgtataagaaccatcggagaactgacccgagttgttggggttcacttcatcaagactgcaagagccccaagaaaaaacaccggcaacaagtagaactaaactatatatctttttcatattgctattttttagaaagttaaattaagaccaaatatgcaatcacgagacaatgggaagttgatgcttccgttcatttccggatcgtaattcttcacatatttgtttggcgaataagtaaacaggttggtcattgtcgcataaactctcagattactgataccaaaacgttttgtaagtttaccgggtaacgtataacccaatgttacgtttttaagtttaaagaatgatccatccacataatacatcgaatcatatccttcataagcacttctatccttggatttatcgatagcatagaacaagacatcctgatctgcttcgatcgtcttgtcatagtaagtaaaataagtaggaatattgtaatccggattaggcgaatatttacctatcacactaccatagttcatcatttgcccccaacgtgcataaaggaagacagacaaatcaaaatctttgtatctgaaattattcttaaagcccaatgtccagtccggagtattacgacctattacctgacgatcataatccgcacgtacaccataaggattttctgccgtaatatcaacgcgctctccttcaggattcatataataataaccatttccgtccttcttcacactaggtaaatccagcttaatatcgcccggttcgcatccgaacaaagcagcagtttccttttcgctatattgccagatacccaacactttatatctatagaaagaaccgactccttcgccgactttgaacaccatatcacccttttttgcattgaacatcatatcctgcccttcgatcaaagatttaattttttctttgttggcggtaaatgtcactgttgagctccaagtaaaatctttcttcacaatattacgagtattaagagcaagttcaataccgcgattttctgtttcagcagcattcttgttcattttataagtagtgctacctgtgtaattacccataatagatgtcggcaatgcctgagaaagaattacatccgttgtttttgtccgatacaaatccaccgtcagatcaatacgattattgaggaagctggcgtcaataccaatattcaagtcatgagtcttttcccatgtcagattacggttagtgatatactccgtaaacttggctgacggaacagtcattcctcccaaagaggttgtcacattttccaaagatgccatagaactgtattcagcaataccggcagtagttccggcaacaccatagcctacacgcagtttcaagttatccaaccagctttttgtaccagccataaatgcttcatccgagattctccagcctacagaaactgccgggaataaattccatctattgtctttcgacaaacgggaatccgcttcataacgactggaagcagaaaacaggtatttacctttgtatgagtagttgacacgaccgataaagcccatccctttcgacatcagatatttgctgttcagtttcttattatcagcattctgcaatgcataccacaacatatcattggtcgccgggttttcaccatagacataatattcttcactctgattgtaattccaggaagtaacccctgtaaccgtcaggtcatgatccttattaaatgtattgtgataagttactatgttttcccatttgtaattatatcccgtcttattggtagcttcgccatatgccaccgtactgcctttcaacacattataggagccttctcccataaatttaccggcacgagattgagaataactgcctccaagctgtgacttgacagacaatccttttaccggtttccattcaagataagcgtcaacataagcccttcctgctttagtattattcttatatactccatcctgttcgtctgctaacggattcgggtctgatgatgaacctggaatcgggaattccgtgatagagccgtcttcattataaggagtacctaacggggtggcaaacaatgctctttccaaaacggcattacgtgaattcttgttggagaaagatgcctgaacattaataccggcattcatccatttattgatttcctgatctatacggacacgggtagagtacactttatagtcatcattctcatacatactcttctcatcagtatagttcaacgagaaataggctttcgtcttctcagtacctccggcaacggaaatactataattctgcttcaaacctgagtgtaatacttcatctccccagtttacccattggttgtttttgatggcatcgtatctttcaccgaaaatttcctcctcattagtagtaccgacaggcttataagaatcttttatataattaatgtatgagtcacccgtacgcatcttaggaactcgggcacccatagtcgttccggcataagcattaaaattgatgaccggttttccactcttggatcctttcgtagtcacgataataacaccattcgcaccacttgaaccgtagatagctgtagaagatgcatctttcagtacttcgatagattcaatatcattgggattcaaggtagcaatatcacccggcataccatcgataatataagtcggcttaaatgcatctgaagagatattaccatcctcatccaactgtaaagagcgggtaccacgcaactgaactgtcggtgacgaacctgcctgacctgaagaattagtgatatccagacctgcaattttaccttgcagcgcatccatcggattcacgcccggattcatggtgatatcctctgatttcacagaagcaaccgcacctgtcaaatcacgtttctttaccgtaccgtaaccgatgaccactacctcatccaaagcctgtgtatccggaaccatctttatattcagcggggcatttccgctcacaatgatagcctgttctttatatccgatataagaaacaaccagttctttacttccggccggaagattaatggagaacttaccgtcaaaatcagttatcgtacctgtacttgtacctttcaccacaatagaaacaccgatcaacggttctccattttcatctaaaacagttcctttcactgtctttgtctgcatgacggcttgcacagtaatatcattcacaccattttctgcataaacagatatggcagaaggggcacacaataaagtcagccctaaaatcatggaaacgcgtctatgctgtgtcttccacgcttcaacaaatgcattctctctcattcgttttaatttaaagttaatattaattttcctttgtttagtaaaatacaattagcataatcttttatatagacgtttccattttacttctgtactcacaaaggacgacaataatacaaaaattcgcttttccaagcctttttttcctcaaatatatgcaaaggataaaaagacaaattttaggctaagccaacaaattctcttttttattgttgaatgaagaataaaaagtgtaaatttgtatttggatgccacttaaactaacaacatattatcgcggaaaagacattcctgatttaccgggaaccaatacttttcattccaaggagttgtttcagatctatgaatcgactccgggatataccccgctactgatagtggcaacagaagaaggcagacctgtagcacgcctgcttgccgccatacgcaagaccaaaaagtggcttccctcctctcttgtcaaacaatgtgtggtatatggtgcaggtgaatttctggacacttctctaccggcaagtaaagagaaggaggaagaaattttcggtgaaatgctggagcatctcacacaagaagcatcacgcacctgcattcttattgaattccgcaatctggataattccatgttcggttaccgtttcttccgaaagaacgacttttttccggtcaactggctgcgtgtccgtaactctctgcatagtacgcagaaagcggaagaccgtttcagcccatcacgtatccgtcagatccggaaagggctcaaaaacggagccaaagtagtagaagcccatacggtggaagagattaaggaattctcgcggatgctgcacaaagtttattcttcacgaatacggagatatttccctgccaatgactttttccgccacatgaacagcatgcttatcagaggaaaacaggcaaaaatattcatcgtaaaatacaaggaaaagattatcggcggctccgtctgcatctattccggcgaaaatgcttttatctggttttcaggaggaatgcgaaagacctatgcactgcagtcacccggcatactggcagtatggaaagcacttgaagatgcccatgaacggggattccgtcacatggagttcatggatgtaggacttcccttccgcaagcatggttatcgtgatttcgtactccgtttcggaggcaaacaaagcagtacccgccgctggttccgtatcagctggtcatggctgaataatcttctggtcaagttttatgtctaaatgtaatctcaagattacaaaacccgtctttgtcacccatccggagcattttttatgctttattccccaataattaaatgcagaaatatttctttattagacaagaaatgtctttctttgtgctgttttatgccatataagcacataattaaaccatataaaaaaatatagttatgaagatttcacacattgagcatctgggcattgctgtaaaaagcatcgaagaagcccttccttactacgaaaacgtattgggtctgaaatgttacaacatcgaaacagtagaagatcaaaaagtaagaaccgcttttttaaaggtaggtgaaacaaaaatcgaattgttggagccgacttgccccgaaagcaccattgctaaatttattgaaaacaaaggtgcaggtgttcatcacgtagcatttgccgtagaagatggcgtagctaatgctttggcagaagcagaaagcaaagaaatccgtctgattgacaaggctccccgcaaaggtgccgaaggtctgaacatcgctttccttcacccgaaatcaacactgggtgtgctgacagaactctgcgaacactaatcataaactctaaaaaaacaacaagaactcatgagtaatcaacttgaaaaaattaaagagcttattgaacgccgtgccgttgcacgcatcggaggcggcgaaaaagcaattgcgaagcaacatgaaaaagggaaatacacagcgcgtgagcgtatagccatgctgttggatgaaggtagcttcgaagaaatggacatgttcgttgagcacagatgcacgaacttcggcatggagaaaaagcactatccgggtgatggtgtagtaaccggttgcggtactatcgaaggtcgtctcgtatatctttttgcacaggactttaccgttactgcaggttcactgtcggaaacaatgtcactgaagatctgtaagattatggatcaggcaatgaagatgggtgctccttgtatcggtatcaatgactcgggcggtgcacgtatccaggaaggtattaacgctttggcaggttacgcagaaatcttccagcgcaatatcctcgcttcgggtgtcattccgcagatttccggtatcttcggtccttgtgccggcggtgctgtttattctccggcactgacagacttcacactgatgatggaaggtacttcttatatgttccttacaggtccgaaagttgtgaaaactgtaaccggtgaagacgtaagccaggaaaacctcggcggagcaagcgttcactctaccaaatcgggtgttactcatttcactgccaaaacagaagaagaaggtctggcattgatccgcacacttctgagctatattcctcaaaacaacctcgaagaagctccatatgtggattgcacagatccgatcgaccgtctggaagattcactgaacgatattatccccgacagccccaacaaaccgtatgatatgtacgaggttatcagcgctatcgtagacaacggcgaattcctggaaatccagaaagactatgccaagaatatcattatcggttttgcccgtttcaacggtcagtctgtaggtattgtagccaatcagcctaaattccttgccggtgtactcgacagcaacgcatctcgcaaaggcgcacgtttcgttcgtttctgcgatgctttcaatatccctatcgtgtcgttggtagacgtaccgggattccttccgggaacaggccaggaatacaatggcgttatccttcatggtgccaaactgctgtatgcttacggtgaagctactgtacctaaagtaacaatcacattgcgtaaatcttacggtggttctcacatcgtgatgagttgtaaacaacttcgtggtgacatgaactatgcttggccaacagctgaaatcgctgtaatgggtggtgcaggtgcagtagaagtattgtacgcgcgtgaagccaaagaccaggaaaatccggctcagttccttgccgaaaaagaagcagaatatacaaaactgtttgccaacccttataatgcagctaagtatggttacatcgatgatgtcatcgaaccccgtaacacacgtttccgcgtgatccgtgctttgcagcagttgcagactaagaaactgtctaatccggcgaagaaacatggtaatattccgttgtaatccaacttttcacattaaaacaagaacgattatgaacaaaaccaaaatcggaatattcctttctctgctgttgctgattggattgacttcctgcggagagcaaaagtcgaacaataagctattgctgaatgaagtcctgatagacaatcaaaacaactttcaggatgactacggcttgcacagtgcatggattgaaatattcaacaaatcatacggtagcgcagacttagcagcttgtttattgaaagtaagcagccagccgggcgatacagtaacctattttatcccgaaaggtgacatacttacattagtaaagccacgccaacatgcgttattttgggcagacggcgaacctaatcgtggtaccttccataccagcttcaaactgaaccctgaaacagccaattgggtcggtctttttgattcaggcagaaagctacttgatcaagttgtcataccagcaggaactttaggtcccaaccagtcttatgcacgcataagcgacggagcagcagactgggaagtaaaaggcggaagcaaagacaaatacgtaaccccgagcacgaacaacaaaacccttgacagtaatgccaagatggaaaagttcgaagaacatgactcagtcggtatcggtatgtctatttcagccatgagcgtagtattctgcggattgattcttctcttcattgccttcaaggtggtaggtaaagttgctgtcaacctgagcaaacgcaatgcgatgaaggctaaaggcatcgataaagtcgaagcgaaagagctttcacaggctccgggtgaagtttatgctgctatttcaatggcattacacgaaatgcaggatgaggtacatgacgtagaagaaacggtgctgaccatcactcgtgtgaaacgcagctattcaccgtggagttcgaagatttacaccttgcgtgaaaatcctaacagaaagtaaatcattccctaaaaagataaaacgatgaaagaatataaatataaaatcaacggtaactcatacaaagtaaccatcggagatattgaagataatatcgctcatgtagaagtgaacggtacgcactacaaagtagaaatggagaaacaaccgaaaactgctcccaaaccggtagtagtacgtcctatgcctaactcaccggctgctcctaccacaccggtagtaaaaccggctgctccttctacaggcaaatcaggcgttaagtccccgctaccaggcgttatccttgacatcaaagtaaatgtaggtgatacagtgaaaagaggacagactatcattatattggaagccatgaagatggaaaacaatatcaatgcagacaaagacggtaaagtgactgccatcaatgtcaacaagggagattctgttcttgaaggtaatgacctcgtaattattgaataatatgggagattttattaactttttaggaaataaccttgccgatttctggacctacacgggatttgccaacgcgacaggtggacatattgctatgatcattatcggtttaggctttatttacttagctgtagccaaagagttcgagccgatgttgttaattcctatcggattcggtattctgatcggtaatatacctttcaatatggacgccggactaaaagtcggtatatatgaagaaggttctgtattgaacatattgtatcagggagtaacgtccggctggtatccaccgctcatcttcttaggtatcggtgccatgacagacttctcggcgctaatctccaatccgaagctgatgctgatcggtgcggctgcccagtttggtatcttcggtgcatacatgatcgcattggaaatgggatttgacccgatgcaggccggtgctatcggtatcatcggtggagcagatggtccgacggctatcttcctttcgtccaagctggcacctaacttaatgggagccattgcggtatccgcctactcctatatggcgttagttccggtgatacagccgcctatcatgcgtctgctcaccaccaaacacgaacgcgttatccgtatgaaaccgccacgtgccgtttctcatacagagaaagtgattttcccgattatcggtctgttgctgacctgcttcctagttccttccggtctgcctctgttgggtatgctgttcttcggtaacctgttgaaagaaagtggtgtaacccgccgtctggctaacacagccagcggtccgctgattgacgttatcactatcctgttaggtttgacagtaggtgcttctactcaggcttctgagttcctgacactcgactccatcaagatcttcgccctcggtgctttgtcatttattattgctactgcatcaggtgtgatcttcgttaagatcttcaacctcttcctcaagaagggcaataagatcaatccgttgatcggtaatgcaggtgtatctgccgttcccgactctgcacgtatctcacaagttgtcggtctggaatatgatcctaccaactacttgctgatgcacgctatgggtccgaacgtagcaggtgtaatcggttcggctgttgctgccggtatcctgttaggattcttaatgtagggacaaaatattaggtgcggatattgctgttttagatgcaatatccgcacttatcattatgttatcttctcttatcattccgttaatctattccaaaaaggctacgaataattcgtaaatacgatattttttagcatcttgcgtctttgttacgacacactaaaataaatatttatgaaacggattattctcctcgccttcctttgtaccaccaccctggtgatggcgcagcgcatcaatcatgttcaggaagcaatagcaaactacgattacgaggcagctctcactctcattgccaaagaaaagccgacaattcccctactcttgcaaaaaggtaaagcacaacggggacttgggatgaatacagaagcactttccacttatcaggaaatcatagccaatgatactgccaatacccgtgcatatatcgaagcagccgaatgctgccgttcattggccaaataccaacaggcactgaaatattatgaacaggcacttgatctgaatccggaaaacaaatatgtgcgtattcaatacatcggactactgctctctttacagaagtttcaggatgctttaggagaaagtagtctgatgacagagaaagacagttccgccatcgccttgcatctgcaggcccaaagtttcgaaggtatgggagagcttctccccgccacggggtgctactataatatacaggagaaataccccgacgactatcttgccgccgccaagctcgccgcactgaacatagccggttcttatttcaacgaagcaattgaagccacggagaaatatcggcagactgataccaccaatatcgctgtcaaccgtcagaatgcactggcatattgtctgaataaggattatcctaccgctatccagcgttatgaatacctggtgagccagggcgacagttcttttcatacctgttattatctgggtatcagctattatgcggaagagaaatattacgaagcacatgactttctggaagccgcccgaaaacatgatcctgaaaacgtaaacctgctttattatctcggccgtgcctgcgccaagacttcatggaagaagttaggcgtagagtatctcgaaaaagcgcttgatctgactattcccaaagacagtaatatggtacggctctatattggcatgaccgactgctacaaaatggcacagatgcctaaagagcagattgaatcgatcagagaacgctaccggaaatacgataaacaaaatcataagctgctctatgatatggctttcatttatttctattcgctgaaagacaagaaaaataccgaacgctgtctggaagcattcttaaaaacacgcccgaaagaagataaggaagaagaagcgaaactaaacgaacgaggcgaactcgttttaggcactaagaattattataatgctgcagccaactggctgaaagacattcaaagtaagcaaaagatagaagatttcttcttgggaggaaatgtgcccgctcagaaaccggaataagcagataaaggatattacgtaaaaaaggctgcaaccgtcaaacgattgcagcctttctatataataggataatctgtgattattcagccaatttgttgtctgaacccagcacattaaggattttgtgcttgtacagtttttccatgttgtcacgagccggaccaagatacttacgtgggtcgaattcagcaggtttttcagcgaaagtcttacggatagcagcagtcatagccagacgagagtctgagtcgatgttgattttgcaaacagcagacttggcagctttacgcaattcttcttcaggaataccgatagcagctttcagagcaccaccaaacttgttgattgtttcaacttcttcttcaggaactgaagatgatccgtgaagtacgatagggaatcccggaagtttttccattacagcatccaatacttcgaaagccaatggaggaggaaccatacgaccggtagccggatcgatgtggcactgttccggagtaaacttgtaagcaccgtgagaagtaccgatagagatagccaatgagtcacaacctgtacgagtagcgaaatcgattacttcttcagggtcagtgtatgtgtggtggtcagaagaaacttcatcttctacacctgccaatacaccaagttcaccttcaactgttacgtcgaactgatgagcgtattcaaccaccttcttagtcaaagcaacgttttcttcgtaaggaagatgagaaccatcgatcataactgaagagaaacctgaatcgatgcaagatttgcaagtttcaaaagtatctccgtggtcaaggtgaagaacgatttcaggatgtgcgcaacctaattcttttgcgtactctacagcaccctgagccatgtaacgcaacaaagtagcgttagcatactgacgagcacctttagaaacctgaagaatcaccggagattttgtttctactgcagccttgatgatagcctgcatctgttccatattgttgaagttgaatgctgggatagcgtatccacccttaatagccttagcaaacatgtctcttgtgtttaccaatcctaagtctttgtaattaaccattttgtttaaagtttattgttagtgaattaaaattctacgcaaaagtaagcattatccaccgaataacgagcatcggaaagaaaaatataatagaaaaaggtttaaatcgatcagcaaatattcatccgtaagcgggtctgacattagattgtaatgtccacctagcaaataaacggctgaaaggttctatcccaaaacaggtattataccataaaaagcacaagacattcttttcgtgccaatcatataattcatagaaatagcataattcacagaagttttttcagcaaagttttttctattccggagaaatgtgctatctttgcgctctgaaaatgaccattacactatttcttaccaaaatagtaacagaatataaattaaaaaaacagatactgaaatgaaaaaaggccttcatccagaatcataccgtccggtagtattcaaagatatgtcaaatggtgatatgtttttgtctaaatcaactgtagcaactaaagaaaccatcgaattcgaaggtgaaacttatccgttgctgaagattgaaatctctaacacttctcacccgttctatacaggtaaatctacattggtagatactgcaggtcgcgttgataagttcatgagccgttacggtgaccgtaagaagaaataattcaatctttcgttaagatgaaaaaagaggagatttccggttggaaatttcctctttttcgtttcatagataaactaaaggaccgcaccattcttcacagagtagtgcggtccgtatattaactggctaaggggaactattaccaggtaatataaaaatggtatagttaagggaatataccataccattatattgtctgatctcctgaaaaatgatggtttattaaatagtactattcaggagaaatacttcctattatatataataatattcagcaggcaaaaaagacggtcctgctgacccgttgcactacatattacagtccacgagggatgagatacagtgggcgcattaacgctccacacgggggacagaaccgtatatctaaggaagccacgagcatattcccacatgctcgtagcttaaattcgagaattaaattctcatatcgcattccgcgactgtaatactagtgcggtgcaaaagtgggaataatctctgataaaatcaacagaaaaggcattttttatctataaacaatcattttcctttaatgttgatactaatttcacatttctaatatacccgtctctactgaacatagtcaagtattaaattgtttacttcccaaacaatgaacgacttatgaaaaatatctatgtgattgcactcgcagccatcctatttcaaggctgcgggcaaaaaaaagagatgacggtacccgccacccgacctgttaagacaactattgtcgaatcaaggtcagtaatcagaaaagacttctccggcattgtagaagcagtggagtatgtcaaactggcattccgcgtcagcggacagatcatcagcctgcctgttatcgaaggagagaaagtgaaaaaagggcaactgattgcagctatcgatcccagagatatcgcattgcagtatgctgccaccaagtctgcctacgaaacagcttccgcacaagtggaacgcaacaagcgcctgctctcccggcaagcgatctccgtgcaggagtatgaaatcagcctttccaattatcagaaagcaaaatcggagtacgaactgtccagcaacaacatgcgtgacaccaaactgacggcccctttcgacggttctatcgagaagcggttggtggagaactaccagcgtgtcaattcaggagaagggatcgtacaactggtcaacacacagaacctgcgtatcaagttcaccataccggatgcatatctttatctcctccgtgccaaagatccccgtttccttgtagagtttgataccttcaagggccatgtgttcaaggcgagactggaggaatatctggacatatccaccgaaggaacgggtattccggtcagcatcactatcgacgacccttcattcgaccgggacttatatgccgtgaagcccggcttcacttgcagcatccgtttcacagccgatgtaggcccattggtgcaggatagctggacaatcatcccgctcagtgctgttttcggcgaaagtgacggaaacaacatgtatgtctgggtagtagaggacaacaaagtgcacaaacgcaaaatcgtcgtcaatgcccccacaggagaggcgcaagtactcgtgtccgaaggactgaaacccggagaacaaatcgtcatagcaggagtataccagttggtagaaggagaaagtattaaatcaatagacaaatgaatttagcaaaatattcactggataacacgaagatcatctatttcttccttgccgtactgctgattggaggtattacctccttcggaaagctgggtaagaaagaagatgcccccttcgttatcaaatcagcggtcatcatgacacgctatccgggagccgaaccggcagaagtagaacggctgatcacagagcctatctcccgtgagatacaaagtatgagcggcgtgtacaagataaaatcagagtccatgtacgggctctccaaaatcacgttcgaactgcaaccttcactttccgccagttccatccctcagaaatgggacgaactgcgacgcaaagtgctcaatattcaaccgcagctgcccagcggtgcttccaccccgaccgtctccgatgatttcggcgacgtattcggcatttattatggactgacggcagatgacggcttcacctatgaggaaatgcgcaactgggcggaacggatcaagacgcaggttgtcacagcagacggcgtgatgaaagtagcgctgtttggcgtacagacggaagtagtcaacatcttcgtttctaccaacaaactggtgggaatggggatcgatcccaaacagctggccaacctgctgcaatcgcagaaccagattatcaacaccggagaaatccgtgcaggcgtacagcagttacgggtgacagccaacggaatgtatgccaacatagacgatatccgcaaccaggtaatcaccaccaaagccggacaggtgaaactgggcgacatagccgtgatcgagaaaggttatctcgaccctccatccaacatcatgcatgtgaacgggaaacgggctatcggcatcggtgtttccaccgacccgcaaagagatgtagtgcagacgggtgagaacgtaaaagtaaaactgaacgagctcctccccctcatgcctgtgggactggaactgcaaagcctctacctcgaaaacgagatcgccaacgaagccaacaacggatttatcatcaacctgatcgaatccatcctgatcgtgattgtcattatcatgctggtgatggggctccgtgccggtctgctcatcggctcttcgctgattttctctatcggaggtacactgctcatcatgtctttcttcggcgtcggactcaacagaacgtctctggcaggatttatcatcgccatgggtatgctggtggacaacgccatcgtagtgacggacaacgcccaaatagccattgcccgaggtgtaaaccgacggaaagccctgatagacggagcaaccggaccacaatggggcttgctcggagcaactttcattgccatctgctccttcctgccgctttaccttgctccctctgctgtagcggaaatcgtaaaaccgctgtttgtggtacttgccatttcactaggactgagctgggtacttgccctgacgcagactaccgtattcggaaatttcattctgaaagccaaaacaggcgacagcacgaaagatccatacgacaagccgttctatcataagttcgcttccgttctcggagtattgatccgcaagaaagcagtgacactggtatccatggtgatcctcttcatcatctcgctcattattatgggaacgatgccgcagaacttcttcccgtcgctcgataagccttatttccgggcggatgtattctatccggacggatacagcatcaatgacgtagtgaaagagatgaaatcggtagaagagcacctggcgaagcagccggaagtaaaaaaggtatccatcacattcggcagcaccccgctaaggtattaccttgcctccacttccgtaggtccgaaaccgaattttgccaatgtactcgtcgaactgacagacagtaaatatacgaaagaatacgaagaagattttgacggatatatgaaagccaattatccgagtgcaatcacacggaccagcttgttcaaactgtcccccgcagtggatgcggctatcgaaatcggctttatcggtccgaatgtggatacgcttgtatcacttaccaatcaggcaatagccattatgcaccagaatccggatttaattaatatccgcaattcgtggggaaacaagatacccgtctggaaaccggtttacagcccggaacgggcacaaccgctgggtgtatcccgacagggaatggcacagagcattcagatcggtaccacaggaatgactttgggagaataccggcagggagatcaggtacttcctatcctattgaaaaataaccagctggattcattccggatcaatgatctgcgcacactgcccgtattcgggacaggcaacgagacgaccagcctggaacaggtagtatctgaatttgacttccagtaccggttctcgaacgtgaaagactataaccggcagatggtgatgatggcacaatgcgacccgcgtcgcggaaccaatgcgatttccgctttcaaccaggtatggtcgcaagtacagcaagagataaaaataccggaaggatataccatgaagtatttcggcgaacaggaaagtcaggtggaatcgaatgaagcgctggccaaaaacttaccgctgacattcttcctgatgtttgtgacgctgctcttcttgttcaagacgtatcgcaagccgaccgtcatcctgttaatgctgccgctgatcttcatcggtatcgtgttgggactgctcgtactcggcaagtcgttcgacttcttctccatattgggtctgctaggtctgattggtatgaacatcaagaacgctatcgtactggtagaccaaatcgatttggaaacagcagcaggcaaaaaaccgctggacgcagtcatcagtgccacaaccagtcgcatcattccggtagcgatggcctccggaacaacgattctgggtatgttgccgctactgttcgacgccatgttcggcggaatggccgccaccatcatgggcggactgttagtagcctcggcattgacactattcgtccttcctgtagcctattgcgccatccaccggatcaaaggagaacaataattatccattatcaactatccattatccattaaaagattatccatgaaagaaatgaaaacccaactcatactattttcactgttgctccttggctccacagcctgggcgcaacagccctgcctgagtcaggacgcctaccgcgaaaaagtggaggcttacagccagatattgaaacaacaaaaactaaagacattggccagttcggaggcgcgaaagatagcccatacaggtttcctgccgaaaatcgacgtaaatgcagacggtaccctgaacatgagcgaccttagcgcatggaacgaaccggtgggcgaataccgcaaccatacctaccagggagtatttgtcgtatcacagccactctacacaggcggtgcgctcaatgcccaacatcagatagcgaaggcagacgaaaagctgaaccagctgaacgaggaactcacgttagaccagattcactatcaaagtgatgctgtctactggaatgcctccgcttcaaaagccatgctacaagcagccgacaaataccagagcattgtcaaacagcaatatgacattattcaggaccgtttcgatgacggaatgatcagccgtacagatcttctgatgatttccacccggctgaaagaagcggaactgcagtatatcaaagcccgccagaattatacattagcgctgcaacagctgaatattctgatgggagaagcaccgaatactcctgtagacagcctgtacaacatcggaatgatctccgctcctgtccggatactgcctctggaagatgttttgcaacgacgtgccgattatgccagtacggaagtaaacatcatgaagagccaggcacaacgtaaagcggctctcagccagttcaatccccaattaaacatgtatttcagcggtggctgggcaacggccacacccaacttgggatacgacgtatcttttaatcccatcgtaggagtcaatctgaatattcccattttccgctggggagcccgtttcaagacgaaccgacagcagaaggcatatatcggaatacaaaagttgcaacagagttatatgacggacaatatcaacgaagaactgtcggcagctctcaccaaactgacggaaacagaatctcaggtgaaaacagcgaaagaaaacatgagtctggcaaatgagaatctggatctggccactttctcctacaatgaaggaaaagcgagcatggtagatgtactttccgcccagttgtcatggacgcaagcacacaccaatctgatcaatgcttatctggcagagaagatggctgtggctgaatacaagaaggtgaccagcgaatagataaaaacaaaattaggcacggatgacacggatttcacggttttaagagttgagtaactaaaaaccgtgtttatccgcgtaatccgtgcctaatttttattggttgttctttttattatgcaaggaaggagatcagtacacccgcagctactgccgagccgattacccctgagatgttacttgccatacaatactgcaatacatgattcttcggatcgtatttcaacgcaatctcattcgccacacggcttgccatcggaacagcgctcagtccggtcgctccgatcagcggattaatcttcttcttggagaatagattcactaacttcacaaagaagataccaccggtaatagaaagagcaaatgcaaggaaaccaccgatgacaataccgattgtcgtccagttcaagaaggcttcagccgtcatggttgcacctaccgaaagtccgaggaagatagtagcagcattcatgatactgttggaagcagcgtcgaacagacggaaagtattgcttccgatttctttcaccagattaccgaacatcagcataccgatcaaaggtactgcacttgggacgaagagagctacaatcgtagtcactacaatcgggaaaataatcttcagtacacgcagattcttgatttccgtcttcgaaggatatttcttttcctgttccttcatgttgatgctcagttctttcttagtacagaacagcttcactaccaacggaatgatcacaggcaccagtgccatataagaataagcggcaatagcgatcggacccagcaaatgcggagccagcttgatcgttgtaaagatggctgtcggtccgtccgcaccaccgataatacccagtgaagcagcttcttgcggagtgaatcccatcaggatggctaccagcagaacagtaaagatacctaactgtgcagcagctccaaagatggaaagatgcagattacgcaacatcggtccgaagtccgtcaacgcaccgacccccataaagatgatcggaggcaggaaaccggtcttgatcagcatataatagatgaagttcataattcccagttcatgcgcaatgtcatgcaaaggcatttcccagatattcttcatcacaccgtttatcatcaccataccattctcgtctgcctgtatcactcccatatctcctccggggaagttggcaagcaacacaccgaaagcaatcggaacaagcagcagcggttcgtactgtttcttaatccccagataaagcaggacgaacgcgatggcatacattatcagaaactgcggttcggcaatgatattgctgaacgcagtcatgtcatataagttctcaaatatctcgttcattatcctatcttcattaatacatcatcttctgaaacagtgtctcccggattagcgcagatagcagttatcgtaccgctaaattcggcacggatagcgttgtaagtcttcattgcttccacataacaaagcacatcgccctctttcaccgcatcgccaactttcaaggcagattcctgcgcattcttcaccaggaagaatttaccttccagcggagaaagaacatctttgccctctcctgccggagctgcagctacaggtgcagcaggcagttcggcatctccgtatgctaccgtcacacgataagcctgtccgtccacctgtacagtcagtgtttttggttttgcatcttcttccggcgatttatctttctcggcacgacgttttgccacgtctgccaggaagtcttccttcgcttttccactcttgtaagcctcatactgagccggatgcatggcatattcgaagagttcttcgtcgtcctctcccacttcccatttgttttccttcatcagcttgcgatacttgtcgagtgagtcagggtaattgtcctgcggattaccttcgaagaatttacgtccttcacgttcggctttctcgatgatttcgggagccagtgtacccggcaggcgtcctgctttacccagcagcatatcccagatatcgtcggcaatcattccccagcgttccttgcctttttccattgccatcacattcatcatggcaaggttcttcacgtactggctgaacggagttaccaatggaggataaccgacgcggggccatacatacgccacttcgttgaatagcttgatcagcagctgatcctgtgtcataaacggcaggttatgtttggctttatacttgttgatagattccagattcgattcgaggtcagccatcagactacccatcataccgccaggaagtcccggaccgatcagcagcgagttcatcagacggttcttcggactgatatacaagccgaggaagtcatccataaattcttgaatcagcgcacgcactttcatgtaggcttccatattgatttccggtacctgatatccggcatctttcagcatagcctgtacactgagaagatcggcgtgtcccgtaccccatgaaagcggttccatacctacgtcaatgtagtcgcaaccggcttcgcatacttcgaggatgcttgccatgttgaaaccgggaccggcatgactatgatactgaataggaatttcaggatgtgccgctttgatattggccacgatcttgcccaatgaaacggggcgaccgatacctgccatgtctttgatgcaaatctcgtccgcccccagcttgataagttctaacgccatattggtgtagtactctaccgtgtggatcggcgaatgggtgatgcagagtgaacactgtgagatcatgcctgcctctttggcatacgtgatggaaggagcgatattgcgtacgtcgttcaatccgcagaatgtacgggtgatatctgtgccttgtgctttcttaactttgtagaacaacttgcggacgtctgccggaacggggctcatacggagtccgttcaatgcacggtcgagcatgtgtgtctgtatgccggcttcgtggaacggcttcgtccattcgcgcacggctctattcgggttttcaccaaacaataaattcacttgttcaaaacctccgccatttgtttctacacgggcgaaacagcccatttcaatgatggcaggagctacctttacgagttggtctacacgaggtacatattttccggcagattgccacatatctcggaaaaccagactaaacttaacttctcttttcatgtttttctatgatatacttttgataggtttataacttttctacttttgtaatctttccttttcctaatgtcaccacattcacagctgctgtgatagccgccattatattacccggaataggcgcaggaccttgtggcgcttccttcttcgcaggaaccacttcttcgggagcatacttgttgacaagagtaatcagtaacttacctaaataaatcacaatcagcagaataacaaatacggtagccatgccgaccaccatcagcaggatcgctgtttcgatattttccatataataaactattagtaattcaagtcgtttgtccaaaaagcgtccgaaaataccaaatatttgtgataaaattaattaagagaggaataaaaaagtataaatcgtaaggttacaataagaaaaaacacattattctttgcatgtctattaaaaagacaaaggaaaagccccttgaggggctctttttattttagggagttattaaaatgttattaatctgataattaaagaaaatggccttcgtccttacactttttatattcacttatcaatctctatttttcaatcatccaatcccccagtgtgccactttcactatcaaaattaacagccaccttcaccactggcagtccacatagagcaaagcgttccggataattctttaaatttatctgttccatagcaactgtcgcattcttatccagtttcaattccatcacatataatgtggcctcagtacgcaacactacatccacacgaccacgggaagtacgtacttcgacatccacatagtatcccagcaagctgaatatgatatagaatacctgctggtaatgaccttcgtactttgtatgatcgcattgaggtatagtagacagaaaggtttgcaaacgccgtaatgccgcgtccatatcacctttccggatatcacgggaaataaaagccaccatgttcgtcgcctcacgtgtgtcattggttacataataaggcaacaagcttcgcatcaatcccaccctcacctctttattaggaatatccaacgtatatagttccaattccttatcgtaatccttgatagtgacatagccgctttgatacagcaatggagtaatgctactcatcgtttcagtgggagcatcaaattcttcgaccgccgccaatttatttcctatttcagaaggctctactccaaacttatccagcatctttatcagataggtaggagtgccgctaccaaaccaataagaattaaatttcccatctgcaaaagcattgagcagactgaatggattatagatgtcgggcgatggataagtgaaatgatagccgtcataattctctttcaacttagccagtacttcctccgcagtaatattcaatttgacagccatcctatccacatcttctttcatttgggtaagtatctcattctccgttatgccacaaatggcagcataaggttcatccatgctgatatttttgatgttattgagttcactgaaaatgctgagctgtgagaatttagtgatacctgtaagaaacacatagcgcaaataaggatcacaggctttcaacggactatagaagttacgcataacgtcacgcaatacccccaagttctcccgttcgtgtaccacatccagcaaaggagcgtcatattcatcaataaggaccacgaccttcctgccagtctgttcataagcacgttttatcagattagtcaggcgcaaattagggtctgtacctgctgcatcaatccctagtgtacgttcgtgttctgttagcatgaagtctaaaagattcatcagtttatctttgtccacgtgcttggccatactcatatcgaagtgcagaaccggatactgtatccattctttctccagcttctccatcgccaatccacgaaacagttcttcacgaccggagaaatagctatgcaacgtagaggttaacaatgatttaccaaaacgacgcggacggctcaggaacatataactggaagcagaatgcgtcatccggtaaacgtattctgtcttatctacatagaggaaatttccctcacgaatcttagaaaatgtctgtatccctataggatataatctctgcaaatcttccataacaactttctttttcacaaagctactaaaaaattccaatattcaaatgtcattcttctccttcttatatcgaatataaagttttgcccactcattcactttctccaaaaactcttcttcggtgcgagtcctataataatattcaagaatacgctcataatgaatcagagctttttcttccccttttttaccttttggtaagtagcaggtcccatatgtatctcttgacacatttttgaaagattcacatgtgctactttaagcaccttttcaataaactcaccgagtttaggatgcacgattttattttccatttttcttattattagttaaaaacacgtcttatatattaaacattttcacactacttcagacatatctgaactcgacttattttatttgtcttactttcgcaccatgctttgaaagtcaaagtcatttattaaacgtcctaatagaagtattctatgcaaaactttttcagaatgtcttatttcatgcccccgattgctcccatcaggaacgaacaaggacaaaccgttacacccgccactctcactcccttctgcgaagtctcagtagagcaagtatatcagatgatcacctgcaatgaaaatctcaaagcactgaccgaacaggtgcgcagcgccgaagatatacgaatggcgaaaacatccttgctgccatacgtgactccgtgcggcacattcatccgccggaacagtaaattcttcgcatctccttccggactcgtagtggtagatatagataacctcgactcctatcagaaagccgtagaaatgcgtcgtacactgttcgacgatccttttctccaccctgtactcgcatttatcagtcccagcaaccggggtgtgaaaacattcgtaccttacagcaacctgtacacagacgatcagagccgtaatgtaagagagagtatgagctgggcaatggaatacgtagaaatgacctacggatcagaaatgaacaactccatcgaaacagttcaaaaagccgtagacacctccggcaaagacatcgtaagagcctgcttcctcagccatgacccacaagcactattcagagaatattaaattataatcacgaatgatcaaacttcaattgtcaattatcatttgtcaattgtcaattatcaaaaaatgaccgatattgaatctttacgcctcctcaccgaagcagtcgaaacagcaggtgccgacattgcacccacttacgccgagtacgtacaattagcattcgccatcgcaacggactgtggtgaagcaggacgggagttttttcatcgcctgtgccggatttccgccaagtatcaatccgcccatgccgaacgaatgttttccaatgcactcacgaaacagcagggagcaatacatctcggaacggcatttcacctcgctgaatcgacaggagtaaaaatctgcagggaagaccggaaggaagttatgaacaaccggacgggtacagtaggtacagaaagttcaccgcacaatttttccacacacgcgcacgtatataataaagtagaagaagaaaagagtgaatcagaagaactgctggaaggcagcgacccgcatcacccattacctactttcaccttagaagactggccgaagctactgctacgtatcataagttatggcactaccgccactcaaaaagacgtactcttgctcggagcattgactgccctgggtgccaccatggaacgatacgtgagatgtcattatgccggcaaataccaatcgccctgcatgcaatccttcattgtagctccggcagcctcgggcaagggagtactatcactcatccgcctgctcgttatgcctatccacgatgatatccgccaacaagttgaaaaagagatgaatgtctacaaaaaggcaaaagtcgcctacgaaatgatgggcaaagagcgtgccaaagcggaaatccccgaaatacctttaaacagaatgttcctcatctccggcaacaataccggtaccggtatccttcaaaatattatggataacaacggaacaggcctcatctgcgaaaccgaggcggatacgatctctaccgccatcggttcggaatacggtcactggagtgagacgcttcgcagagcattcgaccatgactggttagcatacaaccgacgtaccaatcaggagtaccgggaaaacaagaaaagttacctctctctcttgctttcggggacacccgcacaggtgaaaccactcattccttcagtagagaacggacttttttcacgccagctgttctattatatgcacggtatctatcaatggatcaatcagtttgacgagaacgaaacggacctggaagccatcttcacctccattggtctggaatggaaaaagctcttgaacttactcaaggaacatggtctccacacactccggctcacggatgaacagaaacaggagttcaatgatctcttttccgaactgttcacccggtcaacgattgccaatggcagagaaatgaacagttccatcgcccgaatggctgtcaacatctgccgtatcatgtcagtagtggccatgcttcgtgctcttgaaaatcctcagccgtatcaataccaggcatcttctcatcccctgcttacaccggacaaggaaatcgccactgataatatcaaagacggtatcattacccggtgggatatgacgatcactcccaaagattttaaggctgtgttgaaccttgtgaaaccactctatcagcatgccacgcatatcttgtctttccttcctccttcagaagtcagccatagggccaatgccgaccgtgacgcattctttgaggcactgggtatccaatttacccgtgcacagttgttggagcaggctacgactatgggaatcaagcccaacactgccctcacctggctgaaacgactggtaaaacagggactgattgtcaatcttgacggtaaaggtacttacgcgcacgcacgcgtgtgcgtgtgttagggaagggccggaaaagtgtacctactgtacctgttgataacatcgtcttttatcgtttctttatgaaaatcagagtatagcgttttgtattggctaaagctatgctttacgacttctaaagcggtgctttatggcctctaaagcttagctttagctaatacaaaacgcccctcgcagtctacaacacttattacctgttacctaatacttattacctgctcatggttctcccaatgcatccacaatcacccttacctccagcggagtgtaagaacggtgctgcggctgataacctaaatcggacaggcgttcctgaagaccgggacagcggacaatccatttattcattttgcggtaagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgccagtaagttcgggagaataaagctgtgccagttccatacgaccataagcacgtattttgaattctatcatgacaaataagtttctgttttactgtcacaaaagtaacaaaatatattcacattacctacgttttatcagggaataacagactataactgacaacaattgcacattaccgactctcactgtacacaaccgattcttccgagttacagcatactatctttgtgtcatcgaaagggagaaatcctcacgaaagtatgtttaactctttaaaattattattttatgattcgttacaaaatttatcagaaccaacagaaaaaaggcttgaatgccggcaaatggttcgcccgggcggtaagcgacgagacattcgaccttgccaaacttgccgaacacatgtcgaaacacaattcaccgtattccagtggggtgatcaaaggcgtgctcactgatatggtggactgcatcaaggaactgctgctcgacggcaaaagtgtgaaaattgatgatctagccatcttcggtgtaggaatccgcagcaaggctgccgaaacgctggaagagttctcgctggagaagaacatcacaggtatgcggctcaaagcacgtgccactggaaacttatcaacgaccaatctgaagctcgacagccaattgaagcagcaggcggagtatcagaaaccgacaacgcccggaggaggaggttccggttcaggcaacactcccgatccaaaacctaatccggacgaaggagacgaagaagcaccggacccgactgtttaagtcataacctgaaccccgcaaagtctttagcttatcacggctaaagactcattaaaaatcaatatttttttcatttaaaatcaaaacctatgagtaattcatcatcacgatccgtatggagtttcattatcaaagtaatcatcactgtcgctactgctgtaggtggtttgataggagtacaaagctgtatgtaaacttatgcggaccatcacactgattatcattcattgcagtgccacgccagagggaaaatccctctcggcggaggcttgccgacaggatcatatccgacatcggggattccgtgacatcggttaccatttctacatcacacgtgatggggaaatacatccgggacgaccgttagaaaaggtcggagcacattgccggaatcataacgcacattctataggaatctgttacgaaggaggactggatgctgacggacggactaaggatacacgtacgctagagcaacggggatcgttgttagccttaattcgtgagttacgaaagaggtttccaaaagcgttgatagtagggcatcatgatttgaatccgatgaaagaatgtccgtgttttcggtgtgtagaggaatataaggagttgtaaaagaggaggtcaatcacacttatcaaactcatcaatgatttgttccagtatttctttcaattggggcaaatcatttttgatttgttttctacacatagatcccgtctttatttatacagtttctcaacaattcatccatgttattccgcaatctaactacatctacaggacatttaaacagtttttccaattcttccttaatatgaactaaagtaaatatagaaggcctatctatctccacgcatatatcaacatcactaccgtcatgttgctcaccacgagctactgagccaaatattcccatacgagatataccatatttaacagcattctcccgcatgtatttacgaagaagggatagatattctatagtacttaacataatagatacttttagtctattacaaagaaagaaattttccttcaataatcaaagagatattgcttttttctgcccattaccaacttcttcgtattcaacaacggtgtttcactataaatacaacaattttctctgctaaaacttcttgccaaaacaaatatttataaatgtcttcaccaagatcttaaaatcaaaccaccatgagcgatgctgcaaataaaacaaatcatagcgaagacgacgcaacattttatccatcgtatccgtgtacccattgtataacgtagcatacgaagtaacacccggtcgtatctgatacaaaaatacgtaacgagcatcgtgttccattatttgatcaatgaaatacttacgctccggacgtggaccaataaaagccatctgcccgcagaagacattccaaagttgcggcaattcatccaaatgatgttcacgcaaaaacttacccactttagtcaatcgtttatctttcccacccctatatagcgcaggacccattttttccgcatccaaacgcatactgcggaacttataaatataaaacggacggccgaaacgaccgatacgttcctgtttgaaaatagccggaccaccatcttcacgtttcacagctatataacagattaaaaataaaggagaaaaaataatcagtaatatgcccgcaataatgcaatccccaattcgctttacattgcgctcaaaagcattcattccgtcgggaataaaagttgtttgttgttccataaattattaattatagtttggttaaagactattttctcagagcttttttatacaagatagctcgtaaagtgttgggcatcatcctagtaatcacccgtataaagacattatagagatattcagaggaagttatgaatcctaaatttcttagttgattttgaaaacgtagttccgttgtcacatattttaaaccgcctctccgtttaaacatagccggtgaaaagcgaaaatataataagctctcttggatattgtaaaatttagcaccgttctgtagcatacgtatccacagatagtaatcctcaaaaagagggaaatgctgatatccacctgctgctaatacagcttgcttacgaaacataattaccggatgattttccggattacgcttctttgcaaattgacaaatatcatcatgaacctcaggtaactttcttgtagaaataatatttgaagtagtttcttcaaactcatcgatccatgctcctactacatctaattccggatgctcttgaaaaacccttatttgtttctcaaaacgatcaggtttggcaatatcatctgtatccattcgggcaactagatcgtaggagcaatgctttaagccttcattcagtgctttaccaagtccttgattaacaggcaaagaaatcactttcaaaataggatatttttgagaatactctttgacaatacaatttaaatcatctgtcaaaatcccatctttgactaaaacaacctctgcaggtaaaagagtctgatataaaatactatctaagctctttttaaaataagaaatactttcattataatatacttcctgttcgcagtcatgtgcgtgccgtatatgctcatcgtatggaaactcgtgccggagaccacaggaaagtcactggaagagattgaaagatactggacccggtcggaacagtagaagaaagaaaccttaataacttaacacttaaagatatatggattttaaaacactagccaatcaatatcggaatgaattattggataatgtccttccattctggctcgaacactctcaagatcttgagtttggcggttatttcacctgcttagaccgcaaaggaggagtttttgatacagataaattcatctggttgcagggacgtgaggtatggatgttctccatgctttacaacaaagtggaaaaacgacaggaatggctggattgtgccgttctgggtggtgagttcttgaaaaaatatggacataatggagattacaactggtatttttcactcaatcgttcgggtagaccattagtagaaccatacaatattttctcatatacttttgccaccatggccttcgggcagttgagtcttgctaccggaagtcaggaatatgcagacatagcaaaaaaaacttttgaaatcatactctctaaagttgataatccgaaaggtaaatggaataagcttcatccagatacacgaaacttgaagaacttcgctctcccgatgatcctttgcaatctggctttggagatagaacatctgctggaccctgactacttaaaactaacaatggaaacctgcatccatgaagtgatgaatgtcttttatcgtccggagctgggtggtatcattgttgagaatgtcgatatggacggtaatctggtggattgcttcgaaggtcgtcaggtgacccccggtcatgctatcgaagcgatgtggtttatcatggatctgggcaaaaggctggaccgaccggagctcatacaacaagcaatgttaaccaccttaacaatgcttgattacggttgggacaagcaatgtggcggcatctattactttatggaccgtaacggttgtcctccccaacaactggagtgggatcagaaactttggtgggtacacattgaatctttgatttcattattgaaaggttatcagctgaccggagataaaagatgtttggaatggtttgagaaggtacatgactacacatggacacatttcaaagatccggaatatccggaatggttcggttatctgaatcggcagggagaagtattgctgccactcaaaggtgggaaatggaaaggctgctttcatgtaccaaggggattatttcaatgctggaaagtactggaagagttacgagaaacaaatgaaattatacatccatgaaaatcaaatatctaacatataatacattcttatttttattaccctgatatgaacagacaatacttctatataatacttacaatttttctttttacaagttgtagaaaggatactggatcaagtaacccagtattagaacagatgtgccagagattatttcctcaacatgcagattcttttgaatttgaattactaaatgactcaaaccagatggatcgttttatactagaatcggcacacaagaaaatttgcataaaaggaaataataataattctttggccgtaggtcttaaccattatctgaaatattactgccatacgaatgtatcttggtatgcctctgatagcattgatatgcccgaagagttaccagtaattcctcaaccaatatctatccgttctaagtgtgacaatcgtttcttcttgaactactgtacatttggatatacaatgccttattggaaatggtctgattgggaaaggttgattgactggatggcattaaatggaattacgatgccattagctatcagtggacaagagacagtatggtataaggtctggagcaaattaggattaaacgatgaacaaatacgttcatatttcacaggacctgcgcacttgccctggcatcgtatgtctaatgtcgattattggcaaagtcccctgccgaaatcatggttggagcaacaagaagtattacagaaacaaatattaaagagggaacgcgactttaatatgacccctgttttacctgcattttctgggcacgtacctaaagaacttaaagcaatctatccagatgccaaaattcacgaaatgagtcaatggggaggatatgattcaaaatatcgcagtcattttatagaaccaatggactctctgttcaacatcattcaaaaaatgtatttggaagagcagacggcaatatatggcacagatcatatttatggaattgatccttttaatgaggttgattctccaaattggaatgaagatttcctggcaaaggtttctaagaagatatatgagtccatttatcaagtagatgctgaggctaagtggttgcaaatgacatggatgttttaccatgatcaaaagaaatggacacaacccagaatccgttctttcctggaggctgtgccagatgacaaactcatactgttggattactattgtgacagtacagaaatatggaggaatacggaaatgtactacggaaaaccatatatgtggtgctacttaggcaattttggtggaaactccatgatggtcggaaatctggatgatgttgatgtcaaaattgaaaaactctttgtagaaggtggtgagaatgtatatggcctaggagctaccttggaaggcttcgatgtgaatccttttatgtatgaatttgtatttgaccaggcatgggattatccgttaacaactgatcaatggattcaaaactgggcaaaatgcagagggggaaatcaagatagacatattctgaaagcatgggattcattacataaaaaaatatataaaaagtatgcaacagcagggcaagccgttttaatgaatgcacgtccaatgttagtgggcacagatagttggaatacctatccggacatcacttacaacaatcgtgacttatgggatatttggacagaaatgttgaaagccagtcatataaacaatactggatatcgatttgatgtaataaatgtaggacggcaagtattaggaaatctcttttcctcgtttagagatcatttcactcaatgttattcagaaaaagacatagatggaatgaagaaatgggccgatcaaatggatgcactattgatagatacagaccgtctgttatcctgtgaaaccaatttctcaatcggtaagtggattgacgatgcacgttcttttggaaaaacagaagctgaaaaagaatattatgaggaaaatgcacgttgtatcctgacagtatggggacaaaaggcaacccagttaaatgactatgcaaacaggggctggggtggattaacttacagttattatcgtgaacgttggaagcgctttacaacagaagtaataaccgcttcattatccggccagaagtttgatgaaaaacaattttatcaatcaattactgacttcgaatatgagtggacattatccaaagagcaccatcctataatttctggagagaacccgatattgttggccaagacattatctgagaaatatatgcaatatttttattaagtacatacctcaaaataattataaattataaaacaaaacagcctatgaatataataccgaacttataattaaggaaattatcaaatctaaagaagaaaaaaatacagaattacttaactttaaattattaatgtatgatgtcggacttacgaaaaaacattttttcaattaaaatctggactgttacgacattctgtttattatcactagtaaacatgaacgccagtaatactctcgctcattctttacaaaaagatgagatcaaagaagtaaaggacaatcctggcaagaaagtaacaggaaaagtcttggatgaatttggagaacctattcccagtgcatcaatattggtagaaggacgttcaaggggagttatcactgacttggacggaacatttgtgatagaagtcttgccaacagataaactagtcgtttcttttcttggaatggaaacgcagactattttggtgggtaagcaaacaaatatcgtagttaaaatgcaaccccaaacagcagaacttgacgaagttaccgtagtagcatatggtaaacagcgaaaagcaagcgttattggtgccatcaatacagtttcgatgaatgagctgaaaatgcctgttgctaaattgagttccggtttggccggacagttggctggtatagttgtcatgcagcgttcaggtgaaccgggtgcaggtgctgatttttggattcggggtatcaatactttcggtgcaggcaacaaacctttagtgctggttgatggagtagaacgtagtatggaccttgtagatgttgaggatatcgcttctttctctattctgaaagacgctaccgcaacagcattatatggagtgcgtggagccaatggtattgtacttatcacgacaaaacgtggaaccgaatcagcacctaagattaatgcacgcgtagaatatggttttaccaatccagtacgtatgcccgaattggctaatacggaacaatggatcaattattataatgatattactttggaatcatccggacgcttggctatacaacctgaagaaaaagcaaaatacctgaataatacagatccggatctttacccgaatgtagattggatgcaaacattgtttaaagacttctccaacaccacacgcgtgaatatcaacgttaccgggggatctcctaaaatacgttattatgtaggcggctccttttattcggaaggcagtgtattcaatatttcggataaagaccgctacgatgcttcaatgcgctataacaagtttagttttcgttcaaatattgatatcaatgtaacttcatctactgagctgagtctctcactgtccaatcaatatgagaccaagaaccgtccttatggttcactatcagatttgtatgcttatatgatccgaacttctccgatagctactcctactatttattcagatggcactttagctaaaccaagtacgggtaccaatccttataacagcctgaataactctgggtactcgcaggatttcttcaacaatgcgcaatcacttatttcgcttacacaggatttctcaaaaatggtaactccgggattaaaagccaatgttaagttctcatgggacgcctacaatgcgcatacactaaaccgcattgtaacaccatctacctactatgcaacaggacgtgatgaagaaggaaatcttgactttgtaaggagtactgaaggtagtgattatatgaaactcacacggacgaattcgggcacacgtactatcaactttgaagcctcagccaattacgaccgcctctttggagaaaagcaccgtgttggagccttgtttctttttagtatgcgtaactatacagacaatttcccgggtaattatgtagacgcttttgcccacaaaaacatcggtattgccggtagagctacttattcatattacgaccgttattttgctgaatttaacttcggatacaatggctctgagaatttcgcacctgacaaacgttttggtttctttccctcttttgctataggatatatgctaagcaacgaagctttctgggatccgttgcgttctactatccacctgttgaaaatcaaaggttcgtatggagaaataggtaatgaccagattggcggaaacagacgttttgcattcaactccaccatgaaagaaggacaatacggctatattttcggaacgaatcccggtagtggaagtatcgtaggtatttctacaggtattccgggaaacctgaatgtttcatgggagaaagctcaaaaagcgaatgtgggactggaacttggcttatttgaccagcttaaattccaacttgattatttttatgaaaagcgtaccggtatctatattcagcaagaaagtgttccttcaatcgtcggtctcaatgaaacccagtatgtgaatcttggagaaatgaagaatcaaggtttcgatggttctatggagtatgaacaacgatttaatgactggtatgtctctgcccgtgccaatttcacttacaatcgaaataaaaagttgtatgatgataaaccgactcctatatggccctaccaaagtgaagctggatttgcctatcgtcagcaacgcggtcttatagctctaggtctttttgagtcagaagaagatatagccaatagccccaaacaaaactttggaaacgttcgtcctggtgatattaaatataaagacatcaatggtgataacgttatcgacgcatacgataaggtagcgattggctatacggacgtaccggaaataaattatggatttggtattagtctgggctggaaaggatttgacgcttctctgtttatgcagggagtaggaaatgtgactcgtattatcggtggagacgctctttatggtgcctctgataatatagagcgtttaggacagatttacgcagatgtagccgaaaaacgttggacaaccagcaatcctaatcctaatgctacttatccacggctttctatgagcaaggtagagaataatcttcaaccctccacctactggcaacgtaatatgagttttcttcgtttgaaaaatgtggagataggatatacccttccgaagcatatttataaacgtctgggcatgtcatcaattcgtgtttatgcacagggtgtcaaccttttgacattcagcaaattcaaattgtgggatcccgaactcgattccaactatggaaatatatatcctcagatgagaacaatcaccttaggtcttaatcttaacttttaaagtatattagaactatgaataaaaagatacgaattttaggaatattcctatacttcaccgttgcattcagctttgtatcatgcaacgattatctggatgtgactttgctcgaccagcttacacaagacgaaacctttagtaagcgtgtctctaccgaacagtatttagcgcatgtttatagctacttgccacgggaatatgaatatctggaagaaggaagcgcagttccccgtagtgatgaagccatgttctcctggtatcagtgggtcaactacctctctttcaataatggatcatggggaccttctactccaaactataatatttggaaagcaaagtatacaggcataaaacaagctagtatattcatgaaccatgttgacgaatgtttggagattgactctgaaacgagacgtataatgaaagcagaagcacgttttctgcgagcttattattactttgaactattccgtcaatatggtcctgtgtatatctggggagacatcgaatcggatgaacttataaaaccggaaacgatagaccgtcatacagttgatgaaaacgtaaatttcatagctgaagaatatgataaggctattgcagaacttcctgcagagatcagcgatttcacaaaatgggcaggacgtatcaccaagggagcggcaatggctgccaaagcgcgcttaatgctctatgccgccagtccattgtataatggatgcgatctttataaaggacaaatgaagaatctgtatggtgatttcctttttccacaaagtcccgatcctcaaaaatgggaaaaagccgctaaagctgccaaagacgttatagatatgaacatctatgaattgtacaaagaccagactgaagcagaccctttactgcgtgccatcaaatcttatcaaggagttctttttgaagagtggaataaagagacgatctggggtgcctggggacgtaatcctactaatactggactcggagctataggtttctatctgtatagccggtgcatgcctcctagagtttgtgaattgggtgtcggtggtttctgcccgtctctgaaattagtagatacttatccgatggctaaatccggaagatatcctgttaccggatatgacaataacgggaatcctgtaattgatgagcaatcgggatatacaaataccggttttacagaaaatttcaagcagccgggagtcagttttgcacctggatttaaagcgcataatagctgtgtcggacgtgacgcccgtttttatgcttctgtatttccaaatggtttttattggatcaatcaatataaaggcataaaacaagttaccttttttacgggaggatcgtcctcgtacttagaatccggagattgtgtcaaagtcggatatatgtggagacgcccactcgatcctgctcttaatacagaaagtggcagttggggaaccgtattctggccctatttccgtttggccgaaatatatcttgactatgctgaagcttgcaatgagaagcccgaacgcaatgaaacggaagcattgaagtatattaaccttgttcgcgaacgttccggtttaaatgccctcgaaacagcgtatccggaagtgaaaggcaataaggatttgttgcggatgctgattcaaaaggaacgcatggtagaattagcctttgagggacaccgatattatgatgcccgtcgctggatgattgctcaacaagagtttcccggaccggaatattctcttaatttattggccacttcatacgaagattcttggtcgcggacatcaaatgtttggaaaggtggtcctcgggtatttgagcctaagcattatttcttccctatcaatcaagaacaattgagtgaaatgaagaatattactcagaattacggatggtaaatatatgtaatggatataaatatgaaaaaacataagacaatacaattcatagttgctgcactttttattgcatcggcatgtactgatgatcgtgataatctcatggttaatgatcaaatcggactattgcattctacctatacagaaacggagatattccgtggtatggataccccctatcaattatttgttatcaaaagtgggaaaggaaagcaggagacagaagtttccatttctgttgacgagactgttcttcagagttataatacggataatggaacatcgatccaattattaccttccgattgttataccattcttcagcctgctctgcgtctcaacgattccgactatcggaaagcttttgatattaaatggaatgccgaccgtctatccgatcttctttctacgggaaaggaatatggcttgcccatacaaatgagtgtggtgcaaaattttatctctgcagatgatgagcgactaaaaaccattattgtacctactattaaggaaccttatttgcaaatggatgttcctggtatgagtccggttactgattttatgccgactttcggcgatttgaatgaaagagaactgttcgtaaagataagaactaattattctaatgacgaagatatttcatttcagattgaagtcgatcctcagttagtcattgattataataccgctcatggcacggcttataaaatgttgccggagagttcctttactgtagataataaaggagttatattaacaggcatgaaggaaacattcattaaaattaaataccacaagaaagggttaataccggaagagggtacttatttatttggtgactatgtacttccactacgcattacttccgtttcaaaatatggtataagtcctgatgctgcgtccaaactgtacacagttaaattccaaccggacccaatagacaagaaaggatggagtgttatagatttcaacaactgttgtacccaagacggcggatggtatctgaatatgggatggggagtggaatcattgatagacaataatcctggcacacaatggctatgccgatgggatgtaaaagagcccttgccctattactttgtatttgacatggggaaagaatatacattattcagatttggatttgctaaccctgttgcaccagcagcacacgtttgggcaggcacatcgaaagccggttatgtagaagctagtattgataacgagaattgggttaaattaaaagactggacttctcccaaaatcggagaacccaacgttaatatggatgttcctgcgacacaagcccgatacattcgttttgtaataactgatacctatccgacttatgacgggctgagagttagtcttggtgaagtttatgcttggggtatgtaactaaaaacatgaaaattatgaactatttctcactatatctaaaaggattgatatgtttctgtctgttatttattactatggatagtcatgcgctatccatagataaaggatatagacagaataaaataaaagatctggcacttatttaccagggaggagtgcatcgtattgactggacttcggatcaatttctcccctatgtggtacatcagtttgcagatggacataaagactggttatttgacggattcttgtttttggagttcacagatgggaaaggctgtggctttgcaacacgctactcagataaaaatgcaagaaaaaaagaatggctatggttattagatcgtctttttgaagatggtaaagcgctgtctgccttagatcgatgtatcggaacacagattaaagaaatcggaaaaccggattttactcatcagatagtactatgtcttccggaagttcttcccggacaaaaagattggggagaagtggatggtgagccaatggacttttccagacaagaggatcaggtgaaggccacccgttggtatatcgatgagttaatgaagcgattcaaacaggcaaaatacaaacatctgaaattatccggtttctactggctggcagaggatattgatttcaccaaagatctgtcagttccattaagtaagtatattcattcgaagaacaaaacattttgttggattccgtattggcaggcaaaaggctacaaccaatggagagaattaggctttgatatcgcttatcaacaaccgaaccacttttttaaagcctctattcccgataaaagactggaagaagcatgtcaatctgccgccactctgaacatggggatggaacttgaatttgacgaaagagcattgtttgatgccaaggactcgttttataatcgtctggtagcgtatattgatcattttgaaagacaacaagccttccgtacatctgcaatggcctattatagtggcaatcatgcagttcttgatatgtataaatcaacaaacccgaaagatcatgaagtcatggacagactggctaatctgattgtatcaagacgtggcaagcaaaaaaaagaatctcatcagaccaaagttattgcccatcgtggattctggaatacacccggatctgcacagaactcgctagcggctttagtgaaagctgattcaataggttgttatggttcggaatttgatgtatggctgacagctgacgatgaattgatgttgaatcatgacggatggcatgaaggatactctctggagaaaacatcttctgacgtgctacgcactttaaagttaagcaatggagagaatatgccaactttagagcagttccttgataaagcgaagaaacttaaaatacatctgatactggagatgaaacccctcagtactccggaacgtgaaacgaaagccgttgaaatgatcctaaagttggtggaagagaaaaaattgactcacagagtagaatacatctctttttcccgtcatgtgatgtgtgagtttatacgtctggcacctcctaaaactccaattttgtatttgggacaggatatttcgcccaaggaactgaaacaattgggagctaccggggcagattacaattattgggcttatcataaaaatccggattggttgaaagatctgaaaaattcagggatgacctccaatgtatggactgtaaatatcccttctgagatgcaatggtgtattgacaatggttttgatctgataaccacagatgcaccgacagctttcttaggcttataataatcatttggataatatgctgatggaatctgccatcagcatattatatttatactgtttatacggacaagaataacaaaacaatgaaattaagaaatatcatagcaatcatgccttttctggcatcatctttcatgacgcaagctcctgtttatcaagatgtgaatcaccccattggagacagagtggtaggcgtatggaaaactaacagcaaacaagaaagtcatgtcagttgacgaaacaataactttcagtttagctgtcaagaacacagggaaccgtgaaggacaggaaattgttcagctttatatcagagacataaagtcttctcttccccgcccggtgaaagaattaaagagatttaagaaagtaaatttaatgccgggtgaagaaaaaatagtttctttgtctattgataaagaggcattaagcttttttgatgcggaaagacatgaatggatttgtgaaccgggcaaatttgaagctatcatagcagcatcagctatggatatcaaagatgttctcaaatttgaattaaaataaagatagaagccatgacgaaacgtttaatccttgcattcgtatttttatcctggcacttagtagcctgctcgaatggagattcgggaatttcttccggactcccggataagccttctgcagaagaagactctcccgggactgaaacgatatctgaagaaatgagagtgaaaataaccggcgaagatttatatatatcagccaagttagatgccaaaaccgatattctttattggttcaagaagtgtatgttcaatgaactgttcacattttatagagtaggaacaattgacaataatatgcctgctcctgccactctgcccgatgcttctccgacttctcttctgaatctggcttacagtgacaatatcggtccttttaatataaccggatacgggtggtgtggaggaaatcatccctacctggatgaagttactcaaactgctcgcaatatcggttatcgtatttatatagacggaaaagaaataaagacagatctatcgactctgacaaaagagataaagattgaagtaatcaatgaaataatgaacccttccaaagccgataccagtagtggaaaaacacttctgaatgagatcttatgtattgagactgtcaattattctatttatagaaataacattcaagtcttggttactcatgaatttcaaaatgagtctcccgtgacagtacaaatgtattacggaatgcaatctatgtttgacaaggagacacatacattaactgccaatggcaagtatgtggactggacagtacaaaaggatgtttctacctttacaaagaaagagtatccgtcatttcgccgtttcattgagaaaagcgcaaatgtgtatcaatcttcttatctgtttgccgatggattgggaaatcatgaagaaatatcagatgatgatattatattcataggaaattccagcaataagacctaccacaagattatagctgatagagaacacaaaaagggggatattattcattggagtggagtgtatacctggtttaagtctcctgtttctgatgatgatgatttgctgtgttatgagggtgtaatagataataaaaaggtcctttttatagattgcaagaagaacgtcgacaggacaatacagttgcctgtcgattatacaaagaagtcttttacgattatagagaaaagtaaatcaataacaattaccggtaataaagtaacagccaaaggacttagaattgtatccgacgggtccggcagttgtgtgattacctttgattaatttagaaaacgatatgtggaaaaatgtgttagttctggttagcctctgtctgttgtttgaagatgtaaatgctcaaactaccaagaacagatactataaagctaatgatgaaaacgtttcttacgtgggacgtacggaaatacagagtgatggctccgtttctttcgactggaccggtacttatcttcgtacccgactttcgggaggagaattgtctatgaagatttcagatactggtattaattattacaatgtttttgtagacagccttttacacaaaacggtaaaagtatccggtaaagatactttgattaatttcatttccggcatggataaaggcatccatcatgtgttgattcaaaaacgtacggaaggggaatggggaaagacaaccattcatcaatttgtgcttcataatgaaggagaactgatgaaagaaacggagtgcccgtccagacatatcgaatttatcggtaactcgctgacgtgtggctatggtgtagaagggaaagaccgtagcgaaccttataaagctgaaacggagaattgcaacttatcttatgccactattatcgcccgctatttcaatgccgattatacgcttattgcacattccggacgtggagtagtccgcaattatggagattccgtccgaatatctgccgtgacaatgaaagaccgtatgctgaatacatttgatatgaatttggataagaaatgggactttaaaacatacaagcccgatttggtggttgttaatttaggaactaatgatttttccaccaatatatatccgttggaagatgagtttattcatgcttataagctactaataagccgtcttcgtacaaattacggagatgtccctatattatgcatcagtccggctattgctcaacggcagatcgttcaatacatggagcgtatgcgcaaagacttgaatgataagaaagtttatatagcagttcttcccgaaggcctttgcgattcgactacagacttaggagcagtatggcatcccaattacaaaggtcaaatgaaaatggctatgtcattgattccttatatgtcaactatcacaggatggccattgaaaaaggaatcgttttattaagacttaccatgttatataattatcaaaatggcattttgtcattttgataattataaactctctaacgggcgtatttccatcactgcacaggatagagaataaaatgacagagatttgccgttacaggaaatcactttgttgcgaatatgcatctatatgcattctttttgcgttatttttcatgctattctgtaatatctttctttttttatattactttgcatcattctgattattttttttcatcctaaaacaaagtctaataaataagatacccatcattttagagctaaaatgtgctccttttaaacggacttagcgttgcttttaaagcaatgggacgttcctttaaaagcaaccttatgtttatttacaatcaaccttatgttttagctcaatcaaccttatgtttatttcaaactatacggtgttttttatgcaaatgaccgctcgtttattcataatcatgcatattaattcaagattgtatgcatatctctttctatctttactcatctatcaaaagatagaaatagcaaaaatagggaaataaggaaattatgcttcctattttgctatttatctatcattttgttttctgttcaacttatttttaatgcctgttattatactgtcggtatatctattgaatgatgtcaagttctccaaaaccacttgatcttagtaaaaaacatcgttaccaaaacagctaaagacgtaatgattactccctgaaggaacccaagccacgcattctgctggaagtaggacaacagcgaggcaagtcccagtatattagccaacggcataatgaataaatcaccaaccacgtaagcgatcatcggattttgcccggacataacaagaaagcggctacttcgcacacatctgaaataatcacaaacaatacttaagaataagagcgcaaggaatgccagaccggaagttacaaagaaatagctaaaagtggcaggatctttcttgataccttcttgaaaaggttcaaaacatagccccaaaaggagaagatatgctccggcattaaacagctttttccataacaaagcgattccttctgtcggacgtaagaaaaccaatttgccaatcaataacagcacaagtgtcgctaataaattcactgtcaccatacgggtataaagcccatagagattgaatacaataatcaccatagtcaatatcagcagcgcaattcctatcttacggtattgcggtgaagccggctgttcggtatcctttcggcccttcatccattccatcaaatactcaccggcaatgctgccgggaattacaataaacagatatttcagataatcaaaccgatacatccagggcaaaggagtataattgaatatcacctgtgtccaggaaccttcgacagtacttcccaaaataacagccatcagcagcaataaaactcccaaacgcaaccatcggttatgcatcgtaaaaatgtagagggcagaaccgaagatggccatattggctaataacagaataatcacattactaaaatacaggctgaacgttcttccatcggcataagaagtagtaagcatcatgattaccgcaattccgtatgcggctatctttatgccggtatgtgcccagtccggcattttcaaaggaatgcgcatgaacatcggaaacagaaccgcaaagcaaagaatagccagcaaccaggctctgatgtcctgcggagaactcagcacatacggataaaaatgctgaatgaagatggcaaagaaagtcagttgtactccacgtttcaccgcttcatatactaatttcagtttagagtcacctttctctgcacgcttacctatggaaaaagggaaagctgctcccattgcaaacaggaagaaaggaaaaacaaggtctacccatgtaatgccgggcaaagaaggattgaatatatgatcgggtggcggcgtctgcgcatgactcatccaaccggggagcacctgcgttacgatggtagcagaaagtaccatcgtaataatcgcatatcctctcaaagcgtctaatgcataggcccggttattcataaggagcctcctcttttcattccttcctctacttctttccacagatttttggtaatgatatgtacgatgtcaaataccattaatccgtccgaacggcgaaggttcatctctatcgtttccgaaagtttggcggggttgtcatagaactggtccaccagaatacctcccataaatttattacctttcaatatctgacgtaaatgctgacatgagccttctacacaataccacgtaccggattgagcctgcgaatcagtttcgttccagatactccggttcgtttttctgtattcctcgatggttatgtccgtataataattaccggtagcataaaggtctatcagctcggcatagccataatttttatattcgggtgttgcccagctgaaatctttgcccggatcatattctttgctggcaaagtttacgcctacttcataataagatggataccaggcaccggtgtacgtgccgaaagaaacgtcagggttggctgccttgacttctttacgggcaagcgccatgaaatcagtaatgtttttagttcgccattccagccatttccggaaatattttcctggttgcgttgtgtatttcccatctgcatttttagtccaacggaaaatatcttcggggaagtttgcgacttttttacctatgtattcttcaaacttcttacgtgacaatgaagaaaaatcagcggttattccatcgtaacgtacccggtcgagcatcagaccgtccaggtcgggatatttggtcacgacttctttcagaacattcaggatatgggtacgatattcttcgttcaaaggattgatcatggcaccatatttatgcttctcttcggtgattggaatgattcctttatcgggagtgtacaccatcgaagcccattccggatgtccgctatataccattccacggtcaaaatagttgtgtccggcacagaatacattcaatgaggcgtgtatctccagccccagttcgtgcccttttttgataaagtatcccagatagtcaaaatcaccggctttggctcctttccattctttcatttgcggagcatattcacttttatataaaacttcccctgtgatcggacgaatgtcgacaaccgcatgtgtaaagcccagcgatttgattttttccaagtaataatcaatcgaatctttatgactgaagcgctcaaagtttgcttcggcatcaatccacattaaggccggtttctttttgatgacgatccggaaaggagaagccggaagcccggcattattgcataattccccctgcacataattccggaagcagtagcggacttctgtcgggtcactaacagaatcattccatactttcacagtagatgtgccattgatgatctccgcctttgcaggtcggaatataccatcggaacctacgatctcaaaacctttcacattctgattttccggagtcagtccttcctctccatattcaaagtctatttctacagcatttccctggatacgataggtcttgtagactggaccggaatattggaacccttttcggccgtaagtctgggccagtgcccaataagctaaccgttctccaaccttaatcttataaggtgaatgtataaagagttcgctgcctgcgtctccggtggtcaccattcccactccgggaacttccttcatcagctccaactgacattgacggaaccatgcccaatccaacttgtcattcccttcggacttccagggagcaatctggacataataaaatggcatttcagcattatgaaagaaatttctccattgagagaccatggcgggaaaaagctttttataaagagtaggatcgggagtattcgcctctccctggtaccagataactcctttgacagggaatccttcccatggatttaccatagcgttccacaacagggtaggcgtcccggcagcccattcgaatttatcttgatttgtatccggcaaggttacttcggaaaaatgagataaggtttctttgtccatccatgcttcgatctttgacatactccaggagcaatgtattaatcctacaggtacgtccaaagattgttgcaacagattgccgaagaaataagctgttgcactgaaatcggccacttcttccgaagatgcttcactccattgtccgtctattccttcttctttcagagtcgtgctccaattgttctttacggtgtaaagtcttaatggtcgtttaggattagcggacacgatatagggctgcgaaccatagaccggttgtccgcggaacccttttaccggcatttccatattcgactgtccggagcagaaccagacttcaccgatcaggatattttttaaggtcagctcttccccgtccgaaaaagtaatggtatatggtccgccggcttccggagtcggaagagccagtgtccattgtccgttccggtcacaatctgcatagattttccgatgattccatgaagcggaagcatatacacgttttccgggagtagcctttccacgaaaagtaacttctgcttgttgctgcaacaccatgttgtctccccaaatggaggtcaaggttactttagcttctgttttcagaacaaagaacaaacttataagtagccaaaagtatctgtttctgaacatatgattttagtttatttgttttcaatagtttgagtatatacattaccgaaacggtcagtcactttaatctctatccttgcgtttgggtcatgaggagttgcatgaaagagatgctcggtaagaaccggagatatccagtcatatttcaccttttccttatccgaacagatggcttttgccataggatcatatcctttgtacttttgcatttcgcccatcctttgtccattctcataccattctaccttccaaagatcatcccagttccatacattggctatgatatcagaaggatattcatccgacgatcctgccggataagcatgaaactggtgttccagcggataacctgcgcttttataaatccacttcaattgatctccgttcacttcatatataccgtaacctctgggagttccgtctacattgatgtctgcacgccaccaagtgccacacactgctgccgtattatgctccatcaacgaatcattgaaacaaacgttcgtattgaaatgggtatgcccggaaatgatatgcgcattatagccctccaagagtttatatagtgcagctgtattcactgtttcatcctgatccaaagtattatatcttaactttttctgaaggctggagggaatgtgcatgaccacaaataccagcttatccctggacacatacgaaaggtctttttccagccatgcaaaagtccgttcatcaatatatccgatgtactggtagtcacgattgacatagaaacaattgtcgagtacaatgtaatgggcttttcctttattaaacgaatagtagatggggccgaaataactttcaaaagtacggtacgagtactcaaaagtacgtcctccgtaggtcatgtcatggttgccgatagcacgataaacgggaaagtccaaagtagatacggtattaatgtaagatggatacaaagagggggtatcacccacgatgtctccacaatcaataccgaatatgtctctttttcccgaataaggctgtacatattcttttatatcctgcaggaatctgccataggctttcacatcgtcttcggaagtgacttgcacatcagcctgcaccagaaacagatgattcgcatcattctgaggatttttcatcaactcaaaattatatccgtcttgtttatccatctctatttgttgatggaataagggaatggtcttttctgttttcggctgataaccggaaggcacggacaagtaaacaaaccgggcatccctttgaggagcaagcacatattcgcccgacttattagtcagaacacagtcgattccgtccgttacaactactccttgaagtcctttcccatgacaggttacctttccacgaatagtaccggataaattttgagcctgcaagttcaaactcaaactcatcaaaatgacaagttgtaataaatatattttcatagttatctattgttctttatacaaataaggcaattcattaacattaagtctgaaccttgcggctcagacttagtgctatgaatagaaaggagaatacttgtattgagtatattctcagattgaattatcaacttcctatttttgaacggactccagatagttatcaaatcctgtcttgaaagcgttccaatagtcgtacatcttgatatgacagaggtcgaatgcgaagaagccgtcgctattgtttatacatgcgtcgatggcatcaggtattttagcggcttgtccaccgttagtccatccggtaccattgcctatgtccggacctccggagaagggaacgtcacctttcagcaactcgcgaccgtttttgcaaaatccctccattgtccattcgccgctaccataaatcttatcgacagatgcataagcacctaagaatatataatccagatgatcggcataaccatagttcttataatctgctgttgcccatttaggatagtaggctgaggtgtcatatttaggacttgcccaatttactcccgaagtataataactggaataccatgcgcctacatacactccaaaattgatttctgaatttacggattttactttctcacgtgccttgacgataaagtcgtgaatcacttttacacgaaattccaaccatttcttgaaataggcaggctgatctgaaggtatctcatctgtgcctggtgccataatgtcttccggaaaatgagcaactgtttccccaatgtactcttcaaacttctgtttagaaacagccgagaaatcactttccaagccataatcgtcataacggcaacggtccagaattattccatccaagtcatatttagccaggtcacccagtaactgcaaaacgaagttctgcacatcatcgttagccggattcaaaaatttagctccataatcggtctcgtcattcaacaaatccatcgtatttgtcagaccgtcagcgagattagccacacttgcccattccttcttcgagtcatcacggaacagtattccatctgatccgaggttatagggacataagtaaccaccgacgaaagtattgactgacgcatgtactttcagcccctgacttctggctgcatctataaatgcctgcaggtaatcccatgtttcagtacgttcataatatacataacccgaacttccccacacatccattcgcttcacctgatctactgcagtagtgttgaacaaaacatctcctgtagtgggacgcacgtcaacaatgatatcagtaaaccctgcgttttttactttcaccatatctgtggagatattctccttattattcgcataatccggaaaattagctgccgcatcaatccagacatagcgtggcttgatttctgttacatccggattttccggtccctctgttgaattatcattccagggccatccggggattccatcagaatcatcactacatgaagtgatagcaaccattccgcaaaacgtcaataataatattttaaaaagatttctcatattatatatgtttattaatgtcagtaactcttttgaaacacattaattatttgtcgatacaatcaaattcataccctccgataatcttacagttgttgtcaacatagtagagacgaagtttatatccatctgtagttggagcaaacaatacatcacctgttgccgctacaccatctgcagaaccgaacgaagaaagtgaaggattgaatgtcaaagcgtctgaagtagataccgtaccggtaaacgatccgtctgaggttacatcgtacatatataagtacggagtgcctccccattgcgggaagtgagccgtagataccaatacaagatactgcgcattattgaacgttcttgcatccagacagttattattcattgcccaggaattgccattgtccgaattggataaagacttggacgcattattacttgttccattcacccaataaagtacgttaggatcataataggataagaaataatcgctttgtgcagtagttcctttggtgacaaccttggtatttgacacaggagatccccaatagccaacaccatttaccgatactacttcaggacttcccaatacaccgtctgttataatccagcgaacaaacgtattagaaccggacgaggctgtcccgtcacatgtagcaatgatagcggcatttgtattgatatcaccctgtacagatactttggtacccatatccaaacttgtattgttggtataagatatcaataaagttggaactgtggttacagaagaagtcttatagatagagaaggatttaccattagctgcttttgttgccaacaatatgtttcctttactatcacttgtcacacaacctaaagatgcaacacctacgcttcccaaagtcatattgccaatcttacttcctgtagaagcattataataggtaggagcagtagaaccgtcccctaagcaaacaactaaattattgccattaacggccagtgaaggtgagttggctgaagtccagggcaaacctataactcccatatccaatttaaacaattctgtctcactgccttttctatatccataagggatcttatccggcactgccttctgaactgtgtacgtctgcttcgtcactccatcgtgagcgatgaccgtcagttctacaggtgaattgaagtcaagcgcctctgtcttaggatccggcgacattgtcgcatgagaggaaagtgaatattctgccagacaggaagataaatcttctgcagaaatcagagataccgtcttatgctcttcgtcaataattccactaatatcttcggccggtattgagaaacttaataactgacatttattggatttcactctttcacccgtaatgcagatttgtttcttatatccctgcgcatctgtataagtgaagtaattttctttagtcaaatccaatatcgtcaaaacagggttaatagtacagttaggagctaactttgcctggaccctcattgtcttcatatattccgccgtttcattttcactgtcttccggataaaaccatggtataggaatcacatatttatctacagacgcatccgcaattgtgtagacaacagcttctttgtccacataaggacctgatgtaaaaagtgcggtcaagcttgtgattccctgccgctcagcagttggaagtacatattccggatcttggcaggaactcattaatgccaatactcctaatagtaaatattgtatattctttttcataattgttttcattttagatttattgccattctgcatattgagttaccgcaccgttattgtccaactccgcctgtggcatagggaaacggtacatcttagtcgggaagttacgatctttgtcatcacactctacataaatgtaattgaacgaaccgtttgcattctgttctatcttaagtccatgaagacggataccggtgaatgccgttgcagatagtttccagcgacgcatatcccaataatagtgtccttcataagctaattcgactttacgttcctgacgaatcgctttcatcaggtcttctccactcttgtccgaataaggcaagccgactctgttacgaatgtctttgatgtctttattggctttatcggcatagccactcaaatgatagcaagcctcggcatgatttagtaacacttcggcataacgaatttcggtccatggctgtgtacttgcctgcacagaagtgaaactatgagtctcatccaccagcttacgcaaataataacctgtggtagaacgtccttctggtttggcatccgttttccatgcagcccaaccatcagtaccattgacataagatgcgatcgttctgcctttccacgtcgcaccattataaagaatggttgctttgaagcgtggttcaagtttatcgtatggaggagttgccgttgttccttctgcagtatgccaggtactccaatccggaaaaccgctaccgtccgcatattcataagattctaccatttcttgtgtcggagttccaaatcctccggtcattgaattaccatccaatgctttatcacctccgggagccatatagccgtcaaaatcatgagttacagtagaactcttgtcatagcaatattgcagaatagcttcctgacttcctgctttaaatgcattagaataattctctttttcttccagcttatatcccatgcccatcacttcttcggcagcgatccgggcatcatcccatctttctgcataaagcattgcccgtgacagcattgcataagctgctccgctagtcagacgtccattaggggttttatcaaccggtaaatgttcgcccgcaaacttcaggtcctcatatacaaagttccatccttctgcttcggaactgaccggcatatccttctttatattatccagatcttcatcatatataatgacttccttataacgttttaccaagtcggtatataaatatcctctgaagaagcgcatttccgcttccagccgttcttgttccgtctgaccgaatgaggcgtactttttcagtttattgagaccttcattgacacggcgtacatattcatacatcgtcccccaattgcctaaataagtgctgacataacttactgtcagaacggatcctccataagcgatttcgctaggtatctggcatttagacatatagttataggaaccgtatttgagttggtctgtcaacgcttccgtcatgcctgccaggcattgtccgtcacgataaactcctaaataatcgatataacggtagaaatcgttgacagcttgttcggcatattccagtttactccatactagtttatctgatgctttgtccgtcggtgtcatgtctagataatcactacatgaaccaagccctaaagaggctcccaacaatatgatacttataaattttgttttcataataaatcttttaaaggtttagaaagtcagagttataccgcccatgattgtgcgttgttgaggataatatccgttattcactcccggagattcggggtcgattccatcgggaagaccggagatcgtgaataaattggaaccttctacataaattctaagattctgaattcccacagggctcatccactttttagggaatgtataacctagctgtgccgatttgagacgaaggtatctgccattacgcaaccagaaggtagaagctaatccattgtctcctccatgtccttgatttcccagagtcagacgtgggaatgttccattcggattttccgtggtatacgcattctgaaccagatataaaggtgagttggcaccttctttgaatgcttgtgtccagaccgtattgtcatcataaccattatagtaagttccggttaatgatacatcgaacaatgcgcctccagtaaattgtgcgcttaaatcaaatccgttccaggcacaattcaagttcagaccataagtcagttccggacgattgccccgtcctacacgtgttctgtcatcttcatctattttgccatcgccatttaaatccttatatttgatgtcacctacattaggacgggttccataccatgcggaattatcaatttcttcttccgaacggaacaaaccttctgccacccatacgactgaagcgtctacactgcgacctgtacgttttctccattctacagtattgggactatccggataacgaagatagcgatttcttgcaaaagtcaagttgaaactggctccataagaaaatggtttccctgccagatttaatttattacgatgactcactgtgatttcaactcccttgctgtctaccttgttatagttggcatacgtataataatatcctcccattgatggtggataatcgcctcccattgctgtcagaatatcataggtataattatagaatgcatcaaattccatacccagtaaaccattccacatggtaaagtcgaaacctgcattgtaagttaacgtgttttcccacgtcagagtaggatttgcaattacagatgcacgcagcgcctgcatgacttttccgttcagaattgtctggtacgcatttttgttaccgtccatcaggttataagtactaaggaatgcatacggactcacatcgtcattacccaacaaaccgatagatgcacgtattttcatatcatctagaaaagtcagatcggacataaagttttctttggatattctccacgctactgatgctgatgggaaaaatgcccaacgttttccacttacattgcccgcaaacttatacgaaccgtcatatcgtcctgtaaattctgccagatacttattgtcatagtcgtatttcaaacggaaaacgtaaccaatgctacgattggcatcactgtagccggaaataggggagtctgccggttgtccgaaactcaattccggaagttctgcaaaactcatattcttattatatccggagaaactgttttctttataatcacggatttccgcaagtaccatggcttcaacattatgcttaccgaaagaattcgcataattgatgcttccctggcctaccatttgacgggaactgaattgtccttcacctaaatttattccatttgcagttccacgaggatcatccgctttagtccaagtccagtctgtagtggaagtcggcattttattgatataagtagaataaggtgtattcaggtttttattatgtgaggtcttgtagtcataagctccggtaacctttacacttaatccttttacccaaggcagattatattgtaaagagaggttagtctgcaaatcaaagctattggtatgtttgtagccggattcataaatagctgctagcggactattcggtaagcttgtattattctgtgtagtagcggtataaagtccatcatatttttccggtaaatacggatgcatcatgatagtctggtgagcaacggataaccaaccttgttctcccaatgtggaattagaatctgtaccaccggaggcatatcccggagtttcacgttttcctacatttccggcaactcccaaacttaactggaaattcttggccagctgagtttcaatgttggttcttaagttgtaccgtctataagtaaagttatcaatattaccatcctgtcccaaatagccgacagacgtgaaataacgcattttgtcactaccaccctgtacggtgatgttatgcttctgattgatacctgtaccaaatactttatcaatataattgacattatcccacccatcagtaggatcgccgttcaacatcgcttccacatttgcttttgtgaataccggtgtatattgcttcatgtccgtaatacttccgttagccagcttatccatcatatcagccatattataataatatgcaaactggggaccattcataaactgcggaaagtttgcattcatagatgctcctattgaaccgttatatgtgattcttgactttccttcctgtcctctctttgttgtaacaatgataacaccacctgcgcccttcaaaccgtacacagccgcagaagctccatctttcaagacagatacactctcaatatcattaggatcaatgtcattgatggaacgaggcataccatctacaatataagtaacattgtaaatagaaccacgaacccgcaatactgcttggtcatcacccggttctccagagacttgaacagaagaaatgcccggcaaacgtccgcctaacaaacttgatacattggttgccggtgcctttaacagttcgtcgcctttgactgcagaaaccgctcctgtcagggattgtttctttgcagtaccataaccaacgacaatcacttcatccagagatgccacatcatccttcatcaccacattgatcgttttctgtccggcaacttttatatcttgttccgccatacctacatatgtgaaagacaatatatcttttgaagtcgcctgaatgctgtattttccattaacatctgtaactgtaccattagtagtcccctttactacaacacttacaccaggtagagattctcctgtctcatcagtaacagtaccttgcaccaaactctgtgcatgagcattgatagcacatgcaaaaagtgcgcatattgagaaaagaaatatcttcaatatgcgagagttttgcttaatttttgagttaaactctgtcatagaattaatttttagattattaataagattggttaacataataattcattgtttctatagcggttctaatactttccagcattgaaataatccccttggtacatgaaagcaccctttccatttaccacctttcagcggtaacaaaacttcccctctgcgattcagatatccgtaccattccggatattccggatctttgaagtgcgaccatgtgtagtcatgcactttttcaaaccattccagacatttcctgtctccggtcagctgataacctttcagcagtgatatcagagattcaatatgcacccaccaaagtttctgatcccattccaattgctggggaggacaaccgttacggtccataaagtaatagatacctccatattgcttgtcccaaccatagtcgagcattgtcagggttacgtcttttgctttttctatcaatttcggacgattcaggcgtttgcccagatccatgataaaccacatcgcttcgatagcatgaccgggagtcacctgacgaccttcgaagcaatccaccagattaccgtccatatcgacattctcaacaatgatgccccccagctccggacgataaaagacatccatcacttcatggatacaggtttccatcgtctgttccagatagccgggatccaggagatgttcgatctccaaagccagattacagaggatcatcgggagggcgaagttcttcagattacgagtacccggatgaagcttgttccacttgcttttcggattatcaaccttggaaaggatgatcttgaaagtcttctttgctatgtccgcatattcctgattaccagttgctagactcagctgtccgaaggccatcgtggcgaaagtatatgagaaaatattgtatggttctaccagtggtctacccgaacggtcgagtgaaaagtaccagttataatttccatcatgtccgtatttttttaagaattcaccaccctgaacggcacaatccagccattcctgtcgtttttccactttgttgtaaagcatggagaacatccatacctcacgtccctgcaaccagatgaacttatccgtatcgaaaaccttcccttcacggtccaggcagctgaaataaccgccaaactcaagatcttgagagtgctcgagccagaatggaaggacattgtccaacaattcatcccggtactgattcgctagtttcttaaaatccataatattgtttttattatagataggtatagggtacaccgaaggcgggaaacgtttcttgaatggccatgcagaaaaccgcctgcggcttctctatacttctcagttgttgttagtttactgttattaaggtctctttctttcttctactgttccgaccgggtccagtatctttcaatctcttccagtgactttcctgtggtctccggcacgagtttccatacgatgagcatatacggcacgcacatgactgcgaacaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtccgatcaggtacgttcctatccacagggcgaatcctgcaatggacatcgccagtccgcgcaccttggtggggtacatctccgaaaggagcacgaacaccacggcacagatggagacggcacagcagaatacatagaacaggaagaaaacgagcaggaagaggctggatactccccaggaatcaccgaagaggaagtaaatgccgatcagcaggagggagacaaccatccccgaaactccgtaatagaccagttgcttgcggccgaccctgtcaatgatcacaagagcaagaacggtggtcagagtgttgactagtcctacgagaacttggtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccataataaagtacagcatttacacccatgaactgtcccaaaatagcaatgcatacaccaatgatgaccgctttaaaaattccgggtttcattaacatagcccattcagattttgtttcagacgtcaatacagatttcgtttcttttaattgacttgcagcctctgaaactgaattatatatcctttctaatatattgacagctttttcttctttacctcttacgatcagccaacgaggactctccggaataaagaagataatgatgaagaataacacagccggcaatgtttccattcccaacattcctcgccagacttcagtaacaaatatcttattcaaccagtccatacttaactgattaccactttcagcataagccagcaattgatagttaatcaaataagctcctaaaaatccaactgtcacagccaattgatataaagataccaaacgccctctatattgtgccacagccacttcagatatatacaaaggagaaacaatcgacacaacaccaataccaactccaccaataatacgatagactaccaattgggtgaagtctgcggagatcgcacaacctaaagccgatgtagaaaacagagtcgctgaaataatcatcgtcatttttcgtcccagcttatcactcaggataccggcaaaaagaacaccgacgatagaacctattaaagcacatcccacataccacccctgttgcaacgtatccagttgaaaaagttgagtaacctgagcgattgttccggatataacagcagtatcatatccgaacaaaaatcctcccaaagctgctacaacagaaaggaaaataagatagccaaagttaattgtagacttcatatcactcatttaatttcaaaatattctctgtatctatcatataaatgtccggcctgcaagtaggcagattgaggactcataaaatgagaaaattcgaaagtaatagccttatcataccctgcacgtttggcagcttccagcttcatccggagcttatcaaatttaatgggtagaaaacggataggcatatcacggtcaaaagactcggcgttggtccagcattgcataccatacttatctgctaattttttatttacagtaaagaacgcatccaactcatcataatcgatatgtccatcctgaaaagcacaagcatctaccacttcatgaattccatcaaaaatttcattccattctttttcgtgttgttgtacagaaaccgcatcttctcttgtcagtttccctgttcccataatagcctttttgccatcaatccacggagagataaaagtcgggagtccgttcgatatatctttacattgctttcccatagcgcggaaagcatcaatagcccctttcgtggcacggctaatctcgccgctgatgtaccagcctccaaaacttttatacttctctccgtacatcttccaaacctcatcaatcacatacttgttatcctcaatctcccaacttaaatcacctgtatcccaataccgtcctgaatcatacaaaccaaaataaaatttcatgttatacttctccgccagacgcaaatacatatctaccaaatcaaccgacggcatataacatccttttttcagcaaataaggtgaagggtaagtcataaacttacgataaccggaacgaatcataatcactgtatcgataccgattcttttcatatgctgaaaatccagatcccattctttctcaccccagttctgatgaggaatatcatgagatatttcatccaaaaaagttcctgtaatttttaagccattatttttgggaacaatcaatttgctttccaaatcgccagccttgatcttcggggagagttcccctctcccctctccgtcagctgcaaataatgaaggggcaaccaaagcggaagctccggccaaagctgccttctttaagaaatctctacgattattagtttccatagttttaattttttgtttttacttggatatatgttaacctattgaatatacttaccagtgatatcgatctgttttttattgaaaggatccaatacctgatcaatcattacagccatctcccctctcaaaatattccgtttcaaatccggttcttgcattccgtatgctttccaaagcgcttgcggatcaacagtagtatgtagtttttccatttctgctatcttctgaacaagttgaactgcctcctcaatacttaatttatccgctcctgtttttttgaattcatctttggcagccggatacacttcaaacagaccatccagttctgacgccagcaataccgtatccgctctcaaccaagtctgattggaccagtccacattcttaccgactcctttcagaatccccgtagagccaatccgctgataaggagcaaacttcacatccgagacaggaacatccagataaggaagcaaatatcctttagcatccagaatagcattctgaacatcacgaacagaaacatcacttatcttctgattattcttcacagcaagtgcagccaaagctcccgctgcctgaccgatctgcagtacaaccggttgcaaacgagtcgttccattcataatattcgatacggaaatagatttctctgcaacaatcagcccgtctacctcctgaggaatcaatgtacctaatggcaacccatacgaagggatcggatgaaaatacagattaggcaactcttcataaccatgatagcgggtatggtgatgatctaccggataatctcccacagcaatacaagtacggtacagtttttcatcctgtgtatatggattgagtgcatgattcaagttaaagcgtactaatccgtgaattcttctggactctctatgataagggataaagggcaacttatcctctgtcggatattcatcatccgccaatccaagtgtattatatcccagctcatgttgcaggaagtagacaaagcacatcgtataatgtttcgcatattccaacgctttcaagcgctcttccggagtcatttcaatcagattaatataataatcattaccttctatcggccaattaatcatatatttatgatttggtaaccgcccgtaagtaatcatcatatctttagaccagacgcgatccggctctttaggagttatgcataccggactggcacaggcacaggcaaattctttaggatcgtatccttcaggttccggaatagtcacatccttaccataatcttttaatatggcaacataagtaatatcctgcacaatattattcttcttttccggagcaatatcctcgtgcgtgtcatctctgctttccataccaatatcgtacttcactccacacatttttgccacatcccccagttcggtggcatcaatcataaccttcgcccgaaccgttttcacaccttgtccttccaccttcactttagcgacccactcatctcccgtcctttttacttcttcaaggcaagcctgtttccagacttttagattattttccgccgctaccatttcgtgaagaatcttatttccaactgacggttcaaacaatacgttacttacccaacccgtcttcaaagaatccagcccgccataataatcagacaatctattcttaaattctccccaaagtccggcaggcaatctgtaatttccatccacagcactcacaccggcagaagtcagcatcccacccaaccaggtgctttcatagaaacatcatcaatatacctattgtatatcttttcatattctttcttgaaatccgctgcaaaggaaactattttatttcgattagttttcattctcatagataataaatctaaaaaagaatcgtatttttgccaattaataatatgtaaaacgaaattgccaacggattactattagcatacaggcaaagttaatttataaacgatctataatgaataaacgaattttatcagtttttgtttgctgtgccctttactattctgcacaggcacaggacgcgaaaggcggcatcagcactgacatgatgcagcaaatcaaacagagttatcagggcacttctaccgacaaggctatccggaacgccatcagcaacaacgacatccgtaagcttgccctgaaccaggacaacatgaaggggatggatacacatttttctgtcaaagtgaactccaaggggatcaccgaccagaaatcgtccggacgctgctggctcttcaccggcctgaacgtaatgcgtgccaaagccatcgataaataccatctgggttctttcgaattctcgcaaacctatcctttctttttcgaccaactggaaaaggccaaccttttccttcaaggcgtcatcgacaccagcgacaagcctatgaacgataaaatggtggaatggctgttccgcaatccgttgagcgacggcggtacattcaccggagtagcggacatcgtaagcaaatacggcctcgtccccaaagacgtgatgcccgaaacgaacagcagcgaaaacaccgcccgcatggcgaatctgatcgctctgaaacttcgcgaacaggggttacaactccgtgacatggcttcgaaaaaagctaaacctgccgctatagagaacgctaaagtggaaatgttgagcaccatttaccgtatgcttgtcctgaacttgggcgtacctcctacagaatttacctggacgcaatataatgtcaaaggcgagcctgtagaaaccgccacctacaccccgctttcttttctgaagaaatacggtgacgaaaagctgattgacaactacgtcatgctcatgaacgaccccagtcgcgaatactacaaatgttatgaaatagactacgaccgccaccgctacgacggcaagaactggacatacgtcaacctcccgatcgaggacatcaaggagatggccatcgcctctctgaaagacagcaccatgatgtattactcctgcgacgtcggcaagttcctgaactctgaccgtggtctgctcgacgtcaaaaactatgattacgactcattgatgggcaccaccttcagcatggacaagaagcagcgtatccaaagctttgccagcagctccagtcacgccatgaccctcatggcagtcgatctggacaaaaacggaaaaccgaccaaatggatggttgaaaatagttggggtgccggagccggttatcaaggtcacctcatcatgacagatgaatggttcaacgaatataccttccgtctcgttgtggaaacgaaatacgtgaccccgaaagcactcgaagtcttgaaacaaaaaccgatccgcctgccggcatgggatccaatgtttgccggcgaagaataaccaaccgacaaacacgctgcatagacttgtacgctgcaaggtcttccggcctactttattaaagaacgtgtgcgaacacaaaaggaattacggatatttttccgtaattcctttcttttttcctcccgaatcacattattatttattacttttgcggcaaattttatgaaaccattattttatatagcatggcaaatgtaataaagttacgtaaaggccttgacataaacctgaaaggtaaagctgctgagacgtacacaacagtgaaagagccgggattttacgcactcgtacccgatgattttcctggagtgacaccgaaagtggttgtgaaagagcaggaatatgtgatggccggtggacccttgtttatcgacaagtatcatcctgaagtgaaatttgtttcgcccgtgagtggcgtagtgacgagcgttgaacgtggtgctcgccgtaaggtattgaacatcgtagtggaagctgccgcagagcaggactacgaagaatttggtaagaagaacgtatcctcgatggatgcagatgctgtgaagtccgcgcttcttgaagcaggtctgtttgcgtttatcaagcaacgtccgtatgacatcattgcagacccgacggtaacaccgaagggcatcttcgtttccgcattcgataccaatccgctggctcccgacttcgaatttgctctgaaaggcgaagaagcaaacttccagactggtcttgatgccctcgccaaaatggcaaaaacttacctgagcatcagcgtgaaacagaaagccgctgcactgacacaggctaagaacgttacaatcaccgctttcgacggaccgaaccctgccggtaacgtaggtgttcagatcaaccacctcgaccccgtttcaaagggcgaaactgtgtggacaattgatccgcaagccgttatcttcatcggtcgtctcttcaatacaggccgtgtgaatttcacccgcacagtagccgtgacaggttccgaagtgttgaaacctgcttactgcaaacttcaggtaggtgcattgctgactaacgtatttgccggaaacgtaacaactgacaaagatttgcgctacatcagtggtaacgtgctgagtggcaaacaagtttctcctaacggattcctgggtgctttccacagccaactgactgtaatccccgaaggtgatgacgttcacgaaatgttcggatggatcatgccgcgcttcaaccagttcagtgccaaccactcatatttcagctggttgatgggcaaaaaggaatatacgctggatgcacgtatcaaaggcggcgaacgccacatgatcatgtccggcgaatatgataaggtattccccatggatatcatgcccgaatatctgattaaagcgatcatcgccggtgatatcgaccgcatggaagcgctgggtatctacgaagtggctcccgaagacttcgcactctgcgaattcgtctgctcttcgaagatggaactccaacgcatcgtccgtgtcggactcgacatgctccgtgctgaaatggcataatccgcatggcaaattgtaaattgtaaatcgtaaaatagtaatatattaatgaaagcgttaagaaattatctcgataagataaagccgaactttgaagagggcggtaaattccacgcattccagtcggtgttcgacggcttcgaaacattcctgttcgtgcccagcaagactgcgaaaacgggaacgcacatacacgacgcgatcgacagcaagcgtattatgtcgattgtggttatttcgttagtaccggcgctgctgttcggtatgtacaacgtaggttaccagcatttcacccacacaggtgctactggcagcttcatcgaaatgtttatctacggattcctggctgtattgcctaaaattatcgtatcatacgttgtcggtctgggtattgagttcgtcgtagctcaatggaagaaggaggaaattcaggaaggattccttgtttccggtattctgatcccgatgatcgttccggtagactgtccgctttggattcttgccgtagcaactgcattctctgttatctttgcaaaagaagtattcggtggtacgggtatgaatgtgttcaacgtagcgttgatcacccgtgcattcctgttcttcgcttatccgaccaagatgtccggtgacgccgtttgggtatccggcgataccatttttggtatgggacaggctgtagacggtctgactgtggctaccccgctgggacaagctgctacatcgggcacggttcctgcattcaacatggatatgataacaggtcttattcccggttctatcggtgaaacaagtgtgatcgccattctgatcggtgccgttatcctgctgtggacaggcgttgcaagctggaagacgatgctttccgtattcgttggtggtgcattcatggcctgggtattcaatgctatcggcatggaaaacaacacaatggctcagatgccttggtacgaacaccttgtattgggtggtttctgcttcggtgccgtattcatggctaccgaccctgtgacatccgcacgtacggaaagaggtaaatacatcttcggattcctgatcggtgtgatggctatcgttatccgcgtactgaatccgggttatcccgaaggtatgatgctcgccatcctgctgatgaacatcttcgctccgctgatcgactactgtgtagtacagagtaatatcagccgtcgcgagaaacgcgctgttaagtctaaccaataataccgaatgaaaatgaatacaaatagtaatagttatactatcatttatgcttcggtaatggttgttatcgttgcattcctgctggcattcgttagttcttcactgaaagctacacaagacaagaatgtgcagttggacactaaaaagcagattcttgctgcattgaacattaaaaatgtagaagatgctgatgccgaatatcagaaatatgtaaaaggtgatatgctgatgaacgtagacggcacgctgactgaaaacacaggtgagtttgccactaactacgagaaagaagtgaaagaacaccaacgtctgcacgtatttgtatgtgatgtagatggtcagactaaatatgtggttcctgtatacggtgccggtctttggggcggtatctggggatacgttgctctgaacgaggacaaagacacagtttacggtgtatacttctcacacgcaagtgaaactccgggtctgggtgctgaaatcgctactgactggttccaacacgaattcgcaggcaagaagacactggaaaacggtgccgttgctctgggtgttgttaagaatggcaaggtagaaaaagctgattaccaagtggacggtatctctggtggtacgatcacttcggtaggtgtggatgctatgctgaaggcttgtctgaataattacataagttttttaactaaataataaggaggaggataaagaatatgggacaactgttttcaaagaagaataaagaagtattctctgctccgttgggaatcgataatccggtaaccgtacaggtgcttggtatctgttctgcacttgctgttactgccaagctggaacccgccattgtgatgggactttcagttactgtgattacagcgtttgccaatgtcgttatttcactgttgcgtaagacgattccaaatcgtatccgtatcatcgttcagttggtagtggttgctgctttggttaccatcgttagtgaaattctgaaagcgtttgcatacgatgtaagtgtacagctctctgtttatgtaggtttgatcattaccaactgtatcctgatgggacgtctggaagcatttgccatgcagaacggtccttgggaatcattccttgacggagttggtaacggtttgggttatgccaagattctggtaatcgtagctttcttccgcgaactgctcggttcgggaactttgcttggtttcaatatcctgaattatgagcctatccagaatatcggttatgtaaacaacggtctgatgttgatgccgccgatggcattgattatcgtagcttgcatcatctggtatcagcgtgcacgtcacaaagaactgcaagaagaaagtaattaatataaatgaagggtgaagaaggatgaatgaaggtaacactcataaactcgaaattcttcattcttaatttttaattaaaatatatggaacatttattaagtttattcgtccgctccatctttgtggacaacatgatattcgcgttcttcttgggtatgtgctcatatctggctgtatcgaagaatgtgaagactgccgtaggactgggtatagccgtaacattcgtgttgctggttacgcttccggtgaactatttattgcaaaccaaggtgctggctgccaacgctatcattgaaggtgttgacctcagcttcctgagttttattcttttcattgccgttattgccggtatcgtgcaattggtggagatggtggtagaacgtttcagcccgtcgctgtatgcttcactgggtatctttctgccgttgatcgccgttaactgtgctatcatgggtgcttctttgtttatgcaacaacgcatcaatctgggtgcaagcgatccgaaatacatcggtgatgtatgggatgcgctgtcttacgcactcggttcgggtatcggctggctgctggctatcgtcggtctggctgctatccgtgagaaaatggcttactctgatgtacctgctccgctaaaaggtctgggtatcacatttatcactgtaggtctgatggcaatcgcatttatgtgtttctctggtttgaacatctaaaaagaaaggaataagacaatggatatgaatttaatattatcaagcattggggtattccttgtggttattctgttgcttgttgttatcttgctggttgccaagaaatttctggtaccgtcaggtaacgtgaaactaacgatcaatggcgaaacaggactggaagtagagtccggttccacattgcttaatacgctggccgtaaacggtgtattcctgtcatccgcttgtggtggcaagggttcttgcggacagtgcaaatgtcaggtactcgaaggtggtggcgaaatcctgccttctgaagttcctcacttcagccgtaaacagcaacaagaccactggcgtctgggctgtcaggtgaaagtgaagagtgacatggctatcaagattgacgagtctgtactcggcgtgaaagagtgggagtgcgaagtgatctccaacaagaatgtggctacatttatcaaagagtttatcgtggcattgcctaaaggcgaacacatggactttatcccgggttcttacgcacagatcaagatacctaaattctcaatggattatgataaggacattgataagagcctgatcggtgaagaatatctgcctgcatgggagaaattcggtttgctgggcttgaaatgtaagaatgaagaggaaacaatccgtgcttactctatggccaactatcctgcagaaggtgaccgtatcatgctgactgtacgtatcgctacccctccgttcaagccgaaagaacaaggtcccggatttatggatgtaatgccgggtatcgcttcttcttatatctttacgctgaaaccgggtgacaaggtaataatgagtgggccttatggagacttccatccgattttcgactctaacaaggaaatgatgtggatcggtggtggtgccggtatggctccgttgcgtgcacagatcatgcacttgacgaaaacattgcatacgaccgaccgcaagatgtcatacttctatggtgcccgtgcgctgaacgaagtattctatctggaagacttcctgcaaattgaaaaggatttcccgaacttcacattccatctggcactcgaccgtccggatcctgctgctgatgctgccggtgtgaaatatactccgggcttcgtacacaacgtaatttatgaaacttacttgaagaaccacgaagctcctgaagatattgaatactatatgtgtggtcctggtccgatgtcgaaagctgtagagaagatgctcgacgatctgggcgttccggctcagaacctgatgttcgataactttggaggataatcttcggaagttgatttccggtcggagaggaccggaagagtaacataaagaaactggcgggaaatctgtaaaagacaatggtgcttttcagatttcccgctttctttatgcactatcttaccgaatcttttcgtcctttttgtatctttgtccccatgttagagaaaaatgaaataatacagtccgctcttcagaatttgaagattgaatctttgaactcgatgcaggaagctgcgctcgaacagggcacgggcaggaaagatgttatcctgttgtcaccgacaggatcgggcaagacattggcttatcttttgcctctgttgcttaccctaaaaccgaatgatgacagcgtgcaggtgctgattctggtgccttcccgtgagttggctttacagatagataccgtgttccggagcatgggaacttcctggaaaacgtgttgctgctacggtgggcatcccattgccgaagaaaagaaaagcattgcaggaaatcatcctgccattatccttggtactccgggacgtatcaccgaccatctgtccaaaggaaactttgatcccgaaacaatcgagactttgattatcgatgagtttgataagtcgctggagttcggctttcatgatgagatggcagagatcatcacccagcttccgggattaaagaaacgtatgctgctgtcggctactgatgccgaagaaattcctcagtttacgggactgaaccggacagtcaaactggattttcttccggaggcaaccgaagaacaggaaaaccggttgaagctgatgaaggtgctttctccttccaaagataagattgatacgctttacaacttgctttgttcattgggaagcagctccagcattgtcttctgtaatcatcgggatgcggtagatcgtgtgcacaagctactcgaagataagaaactattagccgaacgttttcatggcggtatggaacagccggatcgggaacgggcattgtataagttccgtaacggaagctgtcatgtactgatctctaccgacctcgctgcccgtggacttgatattccagagatagagcatatcattcactatcatctgcctgtaaacgaagaagcgtttacacatcgtaacggacgtacggcacgttgggatgcaacaggtacttcttatctgattcttcacgcagaagaaaaactaccggaatatattcccgaagatatagaaacgatggaactgctggaaaatccttcacgtcctcccaaatctgtctggactactatatatataggtaaaggaaagaaggagaaactgagccggatggacattgccggattcctttataaaaaaggtaatctgacccgtgaagatgtaggtgcgattgatgtgaaagaacattatgcttttgttgccgttcgtcgggcaaaagtgaagcaactcctgaatcttattcaaggggaaaaaatcaaaggaatgaagactatcattgaggaagccaaataaagggagccgaaaaacaacaggtgttctcaaagctgaaaggtgaatttcaagaaccaaataggtgattgggatgctgacaatgacgagatgatcggctttgtcattacaaataatatcattcttttgaagtgagagacgtctctcatggatgacagactaaaatgatagtaaaaaaacaattctgtgacagtctccatttattttcttttaggaagatattggagactcctttctttctgactaatttttataattgtagtctcgttgcttgttagggtgagaaacccttgtttttctctgtctttcttaataaatattcattttgtaaccgttttcctttcactctgtaaccgattattttccacaggttatattttcgccttttatcccttgcttgatatgtatagataacaatatggtgtatatatcttgtataaaccaataaaaagaaagagaaatctgctttaaaacagtatttttataaggaaagatttgtgcaccggaaataaattcgtaaattcgcaaggtcaaaagacataaactaacgaaatgttaaaccaaaaacaaacttcaaatgaaaaagcataatttcaatgcaggaccttccattcttccgcgtgaggtgatagaggatacagcgaaggctattttagatttcaacggctctggtctctccctgatggaaatcagtcaccgtgccaaagacttccaacctgtggttgacgaagcagaggcattattcaaggaattactcaatatccccgaaggttattcggtactgttccttggtggtggtgctagtatggagttctgcatggtacctttcaacttccttgaaaaaaaggctgcttatctgaatacaggtgtgtgggcaaagaaagcaatgaaagaagctaaggggtttggtgaagtcgtagaagttgcttcttccgctgaagctacatatacttacatcccgaaagattacacaattcctgctgacgcagattatttccacataactaccaataacacgatttacggtacagaattaaaagaagatctcaattctccggttccgatggttgccgatatgtcttctgatattttctctcgtccgatcgacgtatccaaatatatctgtatctatggtggtgcgcagaaaaatctggctcctgccggtgttacatttgttatcgtgaagaatgatgcggtaggtaaagtttctcgttacatcccgtcaatgctgaactatcagactcatatcgataacggttctatgttcaacactcctccggtagtgcctatctatgctgcactgttgaacctgcgttggattaaggcacagggtggtgtgaaagaaatggaacgtcgtgctatcgaaaaggctgatatgctgtacgctgaaatcgaccgtaacaaactgttcgtaggtactgctgccaaagaagaccgttcacgcatgaacatctgtttcgtgatggctcccgaatacaaggatctggaagctgacttcatgaagttcgctacagaaaaaggtatggtaggtatcaaaggacatcgttcagtgggtggtttccgtgcatcttgctacaatgctctgccgaaagaaagtgtacaagctttgatcgactgcatgcaggaatttgaaaaacttcattaataatataaatagagtcaccacagattgcacggatttacactgaaatcttattgaatatagtgtgtaggccggtgaagtctgtggtgaatcttttttaaaagatacagataaattatgaaagtacttgtagctactgaaaaaccgtttgccaaagttgctgtagacggtatccgtaaagaaatcgaagcagccggatatgagcttgctttgctggagaaatataccgataaagcacagttgctggatgcagtgaaagatgctaatgctatcattatccgtagtgatattattgatgcagaggtgctggatgctgctaaagaactgaagattgtagttcgtgctggtgccggatacgataatgtagacctggctgccgctaccgctcacaatgtttgcgtgatgaatactccgggacagaactccaatgctgttgccgaactggctttgggcatgatggtatacgccgttcgtaacttctataacggtacttccggtacagaattgatgggcaagaaactgggtatccatgcatacggaaacgttggtcgtaacgttgcccgtgtagctaaaggcttcggaatggaagtgtacgcttacgacgctttctgcccgaaagaagtgatcgaaaaagatggcgtgaaggcacttgactctgcagaagaactgtacaagacttgtcaggtagtgtctcttcatatcccggcaactgctgaaacgaagaactctatcaactacgctctgctgaaagatatgccgaaaggcgctatgctggtgaacactgcccgtaaggaagtgatcaacgaagccgagctgatcaaattgatggaagaccgtgctgacttcaagtatatgacagatatcatgcctgctgctaatgcggaatttgctgagaagttcgcaggacgttatttctctactccgaagaagatgggtgcacagactgccgaagcgaatatcaatgccggtattgctgctgctcaacagattgtcggtttcctgaaagacggctgtgagaagttcagagtaaacaaataatgagatgaatcgtaagactgcttatcgttgctcagtcacttatttgatgataggtgctggtcattaagcagtatatttagaaatatgttatcagatttcgccctcggcttttgcgagggcgtatctgttctactaatcttaaaacataccatgacttatggctattatcaaaccttttaaaggcgttcgccctccacaagacctggttgaacaggttgcttcccgtccttacgatgtattaaactcagaagaagcgcgtacagaagcagctggaaatgaaaaatccctttatcatatcattaagcccgagattgactttcctgttggtacggatgaacacgatgaacgtgtttatgagaaagctgccgaaaacttccggctgtttcaggataaaggctggttagtgcaggatgcaaaggaaaactattacatctatgcccagaccatgaacgggaaaactcagtatggactggtagtaggcgcttatgttcctgactatatgaacggtatcatcaagaagcatgagcttacccgtcgtgataaggaagaagaccgtatgaagcacgttcgtgtgaacaatgcgaatatcgaacctgtattctttgcctatcccgataatgcgaaattggatacaatcattcggaaatacactgccgaaaagcctgtttacgactttatcgctccgggtgatggcttcggacatactttctggattgttgaccaggacgaagatatcgctgcaattactgcagaatttgctaaaatgccggcattatatattgccgacgggcatcatcgttccgctgctgctgctctggtaggtgccgagaaagcaaagcaaaacgcgaaccatcgtggcgatgaagagtataactatttcatggctgtatgtttccctgccaatcaattgactatcatcgactataaccgtgtagtaaaagacctcaacgggctgactcccgaacaatttcttgctgcattggataagaattttgttgtagaagaaaagggtacagatatctataaaccgtccggtttgcacaatttctccctctatcttggcgacaagtggtatagtctgacggcaaaggcaggtacatacaatgacaatgatcctatcggcgtgcttgacgttactatttcttccaatctgattttagatgagattttaggaatcaaagacctccgttcggataagcgtattgactttgtaggcggtatccgcggtttgggagaattgaagaagcgtgttgacagtggagaaatgaaagtagctctggctctttatcccgtatccatgaagcaattgatggatattgccgatactggcaacattatgcctcccaaaacgacttggtttgaaccgaaacttcgttcaggattggttatccataagttggattaagacatattctatatagaaaatagagcggtcaatctctcacaatcaacaggacatttgtgagagattgaccgcttgtttttgtataaatgaccgcccgattccgttaaaacgaccacccgactacctccaattgactgcttgattgcaccccatcgaccgtttgactgcatgaaatgaagcgctcgtttcaatgagaagctttaatattttcgaacagcagatggaatttcgtcaagaaagccgtatctttgcggcatgactgctgaagatacttataaaactatcgtcgaaccttccgaaggtatttatacagaaaagcgaagcaagtttattgccatcgccttgcctgtgcgtacccttgatgagataaaagcgcatcttgaaacgtatcagaagaagtattatgatgcacggcacgtgtgctatgcttatatgttaggtgcagcgcgaaaggattttcgagccaatgataacggtgaaccttcgggaacggcgggaaagcccattctcgggcaaattaactctaatgaactgactgatattctgattattgtagtccgttatttcggtggaatcaagttaggaacgagcggactgattgtagcttataaagcagctgctgccgaagcaatatctgccgctaccattatagaaaaaacggtagatgaagaagtgaccgtaatgtttgaatatccttttatgaacgatatcatgcgtattgtaaaggaggaagaaccggaaattctcagtcaatcgtacgatatggattgcagcatgacgttgtgtattcgtcgttccatgatgcccaaactgcgtgcacgattggagaaagtggagaccgcaaggattcttgatgaagagtaaaataaagaaaaataagaatatatggcatttgaagcaacaaaaagagaatggtgtgaactgtatactttcttccgtctgctgacagaaggaaaagtaacgttgggtacggctaaggcaaagaaaggagaaatcgactggcctattgcaatgattcaacgggaggaacatgacggaacacgctgctactatatagaaaaagagatggtccgcatcaaaggagaaaatagtgagaaattcgttccccgggaagattttgggattgtggcagatttgattttgcaggctgtcaagtcctcttcggaggatgaagtcacttctccggatggagtggaagagtttttggatgaagtcgcaattttcgatctggaagcgaagacggaagatcgtaccgatttttatattgccttctggcatccggaggcaccgttgagcgggttcagcgttcgttcgcgattgggtgctatgaatccgctgttggacggaggccgtgcggctaacttgaaactggaacagagcggagtcaaatttgcaacacctacggtgaataagattaatgcgttgccggaagcccctaatgaagtagcagaacgaatgttgctgattgagcgcttgggtggtgtactcaaatactcggacgtggcagatcgggtattccgtagcaatcttttaatgattgacttacactttcctcgtgtgctgacagaaatggtgcgcatcatgcacttggacgacatcacccgtatcagtgaactgacggaagtaatcaaacagatgaacccgttgaaaataaaagatgaattggtaaacaaacatggtttctatgagtttaaagtgaagcaattcctgatggcattagccttgggtatgcgtccggcaaagatatatactggacaggattcggctgttgaaggtatcctgttgatggatgggagtggggaagttctttgctatcacaagtcagagaaaccggttatggaggacttcctgttcttgaatacccgtttggagaaaggttctctggataaggacaaatacggctttttggaaagagagaacggtacgtattacttcaaactgaatgcaaagatcggattggtaaaacgataaatgcaagtggtgaacgagttgtaagtatagtaaatatagtatatgaaaacgaatgaagttttagaaaatatcaaagcacgtcgtagtgtacgggcttatactgaccggcaagtttcggaagaagacttacaggctattctggaagctgccacttttgcacccagtgggatgcatttggagacatggcattttaccgctattcagaatgcagataaactggcagaattgaatgaacggattaaaggcgcttttgctaaaagcgatgaaccgaaattacaggaacgtggtcatagcaaggcgtattgctgttattatcatgccccgactttggtgatcgtgtccaacgaacccactcaatggtgggccggcatggattgtgcctgcgcgattgagaatatgtttttggctgcccattctctgggaatcggatcttgctggatcaatcagttgggtacgacttgcgatgatcccgaagttcgtgaatttataagttctttgggtgtaccggagaatcataaagtatatggctgtgtagctttaggatatgctgatcctaaaatctcactaagggagaaaatggtaaaagccggaacagtgactgttgtcagatagaaccagactatgttttcgacaaacatggaatggaatgaagagcagcatgataaccgtaaggtttcggagtcgcttcttatgttcatttagctcggtgcttattggaatacgctcggtgcttaacaaaggtaagcccggagctcacatttgctgagctccgggcttattttttcatgtacggatttcctttgaaagcttcttcttattcgaacgttccgtagcgggtcggcaataatttccggtctcccaacgtattgtctacgcgagccacattcacccagaacttattctcacgcacactttctatcggatacgctgctttctcacgtgtgtaggaatgttcccagttgtcattcacaatttcatattccggatgcggggcattgattaacacattatcattcttatccgcttcttcgttcttcacttcctgaatttctttccatatattcagcatgacgtctacaaagttgtccaactccgccaggctttcgctttcggtaggttcaatcattaatgtgccgtgaacagggaaagagagagtcggtgcatgataaccatagtccatcagacgcttcgcaatgtcattttctgagatacccgtttcttcatgtactttgcggcattccaaaatcatttcgtgtcctacgaaaccggtagctccccgataaacaatgccataagtatctttcagacaagcagccagatagttggcattgagaatggctattttagtagcttgggtcaagccttcggtacccatcatccggatgtagccgtatgtgataggcaagatacccgcactgccgaacggagctgcggaaacctgattttgcgtactgccgaagatcgaatgtcccggtaagaatggaaccagatgctcagctacacagataggacctacacccggaccgccgccaccgtgcggtgaagcaaatgtcttgtgcaaattcaagtgacaaacgtctgcacctataaatcccggattggtcaatcctacctgtgcattcatgttggcaccgtccatatatacttgtgcgccacaagcgtggatgatttcacagatttcctttatttccgtctcgaagataccatgcgttgacggataggtgatcatcagtgcagccagtgcttccttgttctcttcggctttggcacgtaggtcgcccatatccacgtttccttgctcgtcgcaagcgcaggtgacggtttcaaatccggcctgtatggcagatgccggattcgtaccgtgtgccgaagccggaatcaatattttgttgcgatgtccctgaccgatgctttcaagataggcacggataactcgcagaccggcatattctcccgcagcacccgagttcggttgcaggctgacaccagcaaatccggtaataaccttcaagtcctcactcaaattgctgatcaattcacgatatccttccgcctgatcttccggcaccaacggatgcatgctcataaattccggacggcttaaaggaagcatttcagcggctgcgttgagcttcatcgtgcacgatccgagggaaatcatggactgggccaatgaaatatccttccggtccagacgcttgatgtagcgcatcatttccgtttccgtatgatagttggagaacacctcgtgcgtgaggaaaggcgtggtacgtttcagtgctttgtcaatattgctcttttccggcacgtcctctaccttctgataatccttgccggcggcaatggcgaagatggaaagcagcacgttcgtagctgctatgtccgttgtctcatcgatgctaaagcctacgtcaccgttttcataatagcgcaggttcacttccttgctcagtgcgatcgtgcgaatctgctgcgccgaaacgtgttccggcaactcgaaacgcagcgtatcgaaatattgtgcattgacttgcgtatatccgaatttctttaattgcttgtcgaggaagacagtgatgctatgaatacgcgaagcaatcgttttgattccttcctgtccgtgatatacagcgtagaaacctgccatcgtagcgagtaatgcctgagccgtacaaatattggaagtggctttttcgcgtttgatatgctgttcgcgtgtctgcaaagccattcggtagcagagcttgccgtatttgtctttggaccatccgatgatgcgtcccggcatattccgcttgtactcgtcacgtgtggcgaagtagcctgccgaaggcccgccgtaaaacatcggtgtacccagtcgctgtgttgtaccgaatacgatatccgctccccattctcccggaggagtcagcagggcaagactcagaatatcggcggcaacggcaactttgcagtctgcttcatgtgccttctttgtgaagtcggcatagtcttccacattaccgctggagttaggatattgcaggatgcaggcgaagatttccggtgagggttcaaactctttgtatttgcctacccgcaattcgatgccttgtggaatggcacgtgtggtcattactgccaaggtctgcgggaagatgttttcgtccacaaagactacgttggcacctgctttttgctgggtacgcgaacgcagagcatacatcatggttacggcttcggcggcggcagtcgcttcatccagcagtgagcagttggcgagcggcatagcggtgaggtcacagacggcagtctggaaattcatcaacgcttccagtcttccttgcgacacttctgtctgataaggcgtgtaagaagtataccatacgggattttcgaatacattccgttggataacggcaggagtaatcgtattataccaccccaatccgatgtatgtcgtatacagtttgtttttacttgccaggtcggcaatgtgttttccaaattcgtattccgtcaacggcttggccagtgccagcggttccttcagtcggatgttggcagggatggttttgttgatcagttcatccagtgagtctacgcctattttgcggagcatcacagctgtgtcttcttcattgatgccgatgtgacggctagctaacaaatctgttttcataatttatgggggatgtttttaagtaatagataataagtaataagtaatatccatgcggataaatatactggcagctacgattattacctgttacttattacctattacttgtattcttttttttatctgaaaaatggattctctgccttctccattccgatggtcgttggcgcaccatgtccggggtatacgactgtctcgttgggaagtacgaataaacggctgcaaatatgatcgatcagttcgtcgaagttgccacccgacagatcggcacgaccgatgctgccttgaaacaatacgtcgccggagaacatgcagttttcttccttgcaataatacaccaggctaccgggcgaatgtccggggacatggattgcttccagtttggtgtgtccgaaagtgatgatatctccgtcatgcagatatttccccaacggaaccggttcttcctgcaattggaagccgaacatacggctctgtttcggagcttcatcgatccagaactcatccgccttattggcttctgccgacagaccgaactctttcagcataaacggattgccgaagatgtgatccagatgtaagtgagtattcagcagatgtttcactgttaactcattggtgaggatgaacttctttagtgcttgtttttcctcttcgtagaagcagcccggatcgatgacaaccgcctcttttgtgtcatcccataaaacgtagcaatttacgggaaacatattaaactcaaatctctttattttcatggttttgataactcctgattcctatatttgtgaatatactaccttctttgtttcaaagaactcttcctcgaagttttcgctcaggctgtggatgactgttttatgcttgaacggcatcgtttcatgctccagttcgcctcctttgagacagatcagtccgttgggcatagcattctgctgcttgggggaaatgttctttttgatgatcttgatcagatccgccaaaggcattacggcacggctcacgacgaagtcgaacagttgtttttcctcttcggcacgggcatgacggaaagtgacgtttttcagtccgatggcattggccacttctgtcgccacacgtactttcttgccgatgctgtctaccagatgaaacttggtttcggggaacaggatggcgagcggaatgccgggaaatcctcctcctgtacccaaatccatgaccttggttccgggacggaattgaatcactttggcgatgcctaatgaatggagaacatgatgctcgtacagattttcgatgtctttgcgggagataacgttgattttcgcattccagtcgatgtagaggtcgtatagagcggcaaactgtttacgctgctcttccgtcagatccggaaaatatttcagtatgatttccactttaagtattttgaatggtgaattttgatttataagtgaaatgaatatccttctgcatcacacggggcaataacaacaggatattcattggtgttcaatcttttaatagctgtttaatctttcagatctccgagaattgggttgctgcccagcagatgttccatcatagagtatggaatggtgactttgacagggcccatcgaatacggcgtgatgtcgtatatattatagtagaaggtgataccttctttactcagataaaagttctctgtcggggcgatgtctccggtcgaagcataccccatgtcttccagcgcttcgtgcgtagtcactttgttgtcggccatcagctggttccagatcagatctgtcagggcttcctggaagtcgcctacaaaaatatcatcgaggcggagcggacgcatcagagtgagatccatgttcaggaaagtcgacatatacataccgtgtgcgcctccggtatattcgttgtagtcaacgcggtatactagcaggtctttctcatatagttgcacgtggctttcgatgctcttgtaataggagtaccatgcgcctaccactgcatcgctttctttattcttttcgtcttcggcgtacatcggctcctgatcgtggcgatactcgtcaatgtaattcttggcgtattgcttcactaccgcctccggtttttcgccgatatatttgtctccgaagcagacggagatgaagtaagcgttcagactgtctttcagcatatcatccgatgacttgacgggataggcgaagttgatgataatattgcacgcgggtttggcggtgtcattaaagaggtgtgccgtctcgttaacctgtatactatcgaattgtaatgctcccgtgtttttgttcatcttgtcatgacaagaaaacaaaaagccgcttaccgaaagtataaccgcaagcagactgacatattgttttttcatactcgttttttctataaattcaacattgatcatatctatcactatcgacaaatataaatgaaattaccgaatactgcgaataaaaaaggaaaaatattcagctactttcttcggcaatgtatataggggatgccattgttaatgattctttttttcttgcttctgtatcatatgttacagttttaatctgtacgccgtacttatctttgcagaaaaaaatagattatggaacagttacatgcacacgaagtccttcacatgatggagggaaatagttatactgaggcatctctgagggctgcaatcgtagagaagtttggcgaacatcagcgtttttatacttgttcggcagataatatggaagtagacgaactgatcggatttcttaaacgaaaagggaagttcatgcctgccggtgaggaatttacggtcgatatcagtaaggtatgcagtcattgattctctgtggcggacggtatgatagataagccaataggatagttgagagaagaaatgttagtagttgtagattatacctgtcgtttttcatagatagggaaatccctatttgcaagtaggaagaagtctttgcgaagggaattttctcatactacatttggggtattcaaaaaactactaaactatacctattatgaaaaagagtcaaatccttatgtctttgctgctggtgatattgctcagcagttgttatgcaagcagaattacttatgagaatttgagtattatccaacgtgggatgtcttctaaagaagtaatagccattatgggtaaaccgagctatcgaagttttgacgaagagagtgagatgctggaatttcgtacttccgagtcaagtattgcaggagtcgttaatatctggttcgttgatgaccgggtgactaagatgaaaagttattataccaatggctgtatggaccggaacagagccatagaggataaggaagaggaggaatctgcaaagaaggaaaagaaagaaaaagaagaaacaagcgcccgcatacgtgtgacgacggacggaaagcatatcatacagaccggttccatcatagtcactccggatggaaagcacgagacggtggtcagtgattgtggtggagtaatcataacagcttcgggggagcatatacttgctccttaacgccttccgtcaattcaccatacccttgtcaataccaaatttctcgtctgtctgacattcgccggcaggttccacgtgtactaagatatcatagacattgtctatagagctttttatgcttttctccacagcgtcggctatctgatgggcctgtgtgatggttatctgcggatttacctcgatatcgagggtaatcatataaagatttccgatcattcttgatcttacccggtgtggattgctcgcaccgggaactgtttctaccgcttcgaatatcttattgtacacattgacatctttgacgccatccatcaattccacattcgaatcgatgaaaatgccaatcgaagattttatgataaagaggctgatgattagtcctgtgatggagtcgagtataggcagtttgaatatgaacgtgaatatcagtcccagcagcacaccggaggaaatgataacatcattgcgcatattgatggcattggccgtcagcatggagctatctatctttttcccttgtttgtactgatataaagccaatagaagtttgccgataatcgaaaagatcgtgacgtatatggcaatggctgacggaatttcttttgcttcttcggaaaagatacttccgatagatgatatcaacatttgcacccctgcatagaatatcacaagcgaaagaattttagtcgcaatcccttcggctttctcatagccgaatacgtacttcttggaaggcggctggctgataatgcgtgctgtgaaaatcatgacaatggagatgatcacatccgttgccgaatcaataccgtcgcctagcacggcaagactgccggcccataaacctacgatgatttttgatgtggaaagtatggcattaccaatagtactaatccaggaagttctgattaatatctgctctcttttagctttcatgtgattaagcctttgacattccggttagtatatagctgcctttcaagttattttctttcatataattgactacttctatccggcaagctgacattaaagcgtatcctgttaagttcccgtttatagctttaatgaacgaatactctgtatcgttgtggatgaaagatatacgatgatattccatgacatgatgtatttaaaagaactaatatgtggtcaaatatacggataatatcagtagtacgaataaaaatggagaattatttaatttgatattgttgccggaataccttatctttgtctcccgaaatgaagagactagcctacataacagcagtgatcctttctctcctgattatctattcaggggcgggagtatctattgttcattattgctgttcccgttgtgagactgtgcagggctgttgtgccgatggctgtcccaaatgtaagaagtctcatacttgcgattcaaagaaagattgtagagaaaagggctgtacggcaactatctataagcccgatttgatgaagcatatttccgaactgacagtttccgttccggtgataacacttttctgtgaacagtattgtcagctatttgctttcacttctatagaccggacggtggacttttccagtcttccttctccgccatctccctgtccgaggcagaagctggcgttacattccgtttttctgatttagctgttatttcatcttttttgtccgattgtactttgttttcagcctttgcagggtatgaaaacaaggagaatgaatgcaactcagttgcaagagaaatgaattaattttgtatcgcaaaactaagtccaagaaagaatgaaatatataataatgggactgttctcattacttgcagttacgacacaagcgcaggtgcggggaatagtcaaagataataccggagagcctgttccgggtgctaatgtattctgggtgaatacgggtcagggtgtaactaccaaggaagatggcagcttttctatctccaaaccttcgaagagtcacatgctggtaatcagttttatcggctttcagaatgacacggttcatgtcagcaagaagaatcaggaactggatattacccttcgggaaggtgtagaactgaacgaagtgaatgtagtcagccgcagaatgggaacgatgaagttgcgcagcagcgtgatgaacgaagagatgataagcagtgccgaattgagcagggctgcctgctgtaatctgggagaaagtttcgtgaccaacccttcggtggacgtgagctattcggatgcggcaacgggagccaagcagatcaaactgctcggattgtccggaacttatgtacagatgctcacggagaatatcccgaactatcgcggtgcggcatctccttatggtctgggatatgtccccggtccgtggatgcaaagcatacaggtttccaaaggaatctcatcagtgaagaatggttacgaagccatcacgggacagattaatgtagagttcaaaaagccgcagttgccggaggccgattgggtatctgccaatcttttcgcaagcagtaccaaccggtatgaggcgaatgcggacgccaccttaaagttgtcaaaacgttggagtacctctttactggcgcattatgaaaacgaaaccaaagcgcacgacggcaatgatgacggcttcgtggatatcccccaagtagagcagtataacgtgtggaaccgatgggcctatatgggagatcattatgtctttcaggcaggcttcaaggctctttccgaaagtcgcactagcgggcaggcacatcatacggatatgcagacgggtgatctttataaagtaaacgcagaaagaaaaagcaaggttgatgataatacagcaaaaatgcagtctattaagtggttaggtgtttaactcataatactgcataagctgaaaaaggaggtccgataaaagctgcgaaagacttcagttcccatatcgttactgatataacaggaacaagaaacggcacaacagattctatttcagtaatttgcacagtttttcatacctgaggacaactcgcttgatattaactttgtaacgatcaaaaaagtatgaaaacgagtatgagcagatcgaccttcaaaatcctcttctacgtgaagaagggcagcgagagagccaacggctatctccccctgatgtgccgtcttacggtagacggcgaaatcaagcagttcagctgcaagctggacgtgcccccgaaactttgggacgtgaaaacggcacgtgccacgggcaagagcgccgaggcgcagaaaatcaatgcggcggttgaccggatacgcgtggacgtgaaccgccgttaccaggaactgatgcagtccgacggctatgtcaccgccgccaggctgagggacgcctgcctcgggctgggcgtgaaacgcgagacgctgctgaagctcttcgagcagcacaacgaggagttcatcaagaaagtgggacacagccgcgtgcagggaacatacaaccgctaccgtaccatatacaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggttacatgatcgggctcaagcacgtcatctccatcgcccgcaacagcggtgcgcttcccttcaaccccttcgccgggtacatcaattcccccgagagcgttgaccgaggctacctgacggagcgtgagatacagacgttgatggagaccccggtgaaaagcgggacctgcgaactggtacgcgacctcttcatcttctctgtgttcaccggactggcatacgcggacgtgaaggcactgacgaccgaccggctccagaccttcttcgacggcaacctctggatcatcacccgccgtcgcaagacaaacaccgagtccaacatccgcctgctggacgtgcccaagcgcatcatagagaagtataaggaactgtccaaggacggtcatgtatttccggtaccgagcaacggcagatgcaacaccatattgaaggaacttggcaggcagtgcggtttcaagatacggctgacctatcatgtggcccggcatacgaacgccaccaccgtgctgctctcgcacggtgtacccatcgagaccgtaagccgtcttttggggcatacggatttgaaaaccacccagatatatgcccggataaccaaccagaagatcagcagcgacatggaaatcctgtcccataagctggaaaagatggagaaggaaatatgcgatgccatctgaggaaatggtatttatgaaacggatgattttccccttcctcatcaaagttcgtccgtccctgcgggactccgcgttttcccttcggtttccggcagaaaatttccgtacggcgaaattttctgccggaaaaacgctccgaaagcgcagggacggacgtaagagggattcagaaggcgaaaactgcgaccgacgtagtgcatgtgcgacaaggaaaagaactgtccgggagcccccttttcatgccgtaccccggcatgaaaccacttttctctccggctgtggtgaaggctctcctgctccctctgcattgcatatgcgggttgttttgcccatatccacgtccgccggtattgcctgccctttccttgagaaaaacggcttaccgcaacgggtggcgtgacacagacttttccggatatggaggaacattccggaaaaaagagtggaagacgggctattatttggctgtataacaacaaagttgtatttttgcaaaaaataatattatggctataactatcaagaacattccggttttggagggcgttacggcggaagatttcgtacgcagtgcagacaagaacgccgcaaaggtaacaccccggttatcagtggaggcaaagaaacggttgcgaaaagtattggagaaatcccgttcattccggttcaattaacagcaatggacggtatttctttatatgatgattgtgtcatgcttgcctataacaaggaagtacggaggaattgccttcctttcacttgtggcgagaatgaccttgatgatttttttctcaatgatgccgatctgtatgcggatgaactccttgggaaaacatattgttgggtgacgactgaaatcccgcatcgtattgtggccttgtttaccttgtccaatgacagtatcaagaccagattaatatcccccaatgataaaaacaggctgcaacgcaatattgtaaatcctaaacgtggacgcagctatccggccgtgctgataggaagactgggggtcaatctggaatatcagggtacatcaagccacgtaggacggcaactgatggctttcataaaagactggttccgtcatgaggacaacaagacaggatgccgttttatcgtggtggatgcatacaatgaggaaaagattctcaggtattatgaaagaaacggtttcgttccactctataaaacagacgtgatagaaaagcaatattatgatattccgcaagatgaacctttgaaaacccgtttgctgtattttgatttgaaaaaggactgacataataatatatcagtaaaatcctttagggtgacaacgggttccaaagacaggctgtcgctacgattacctgccatatggcaccggccgttttcttgatggcgggcggtggatttcatgggaagccaatccggaatgacaagtaatgccgcacctgtggcataatagagcattattttgaaggcggagactttgtccggttcttctttttccaaggttttccgtcggatgtcttcaagttttccacacttgttttagaatagtccgcattatcagcagattgcgagtttcagtctgccgttccgattctctttattgcatcgtagcatgtcgttgatatattccaaatacttatccatgaataggcgacttataattttgtctcaggcaaatatcgagacacactcccgaatgaggtcttccatgattttaaaagactccgtatttcggaaggaacaacgtacacatacaatttctccggaacggccgactttcctgtcacttccctgtaatcctccccaaaatcaacaccgccgtataaactgcatgaaagcccgggcacgcttcctgtttccaatcccatatctgctccttccgcaacatcacgtattgccgttctcatttcgtatccttgaatatttctccaaacataccaaagacagaaaagctgcatggaatctaaattctcaccggacagacaatagatagaaggaaggaatccatcatcctcatttcttgcggcaaaaatagttgtttttcaggccggtcccgcaaggcggcccttcgggctggttgcacgtgaaaaaatcttcctcacgcttcgcgttagcgtattttttcacggcaagccttgccggagaccgccgaaaaacaaactggaggaagcacaagaaataagaatgcctacccgtgtaggccatgtataactcaaaaaaatataaagctatggcagacaagagcgcagaaaaggaaagactgttcaacgagtggttcactgcatcctatgacaggttgagagggacgttacgccggtacggaatgctggacgaggacaatttccatgacacctacctttttgtaagaaggcaggtgctggttcccggaaaggacataacggactatgacgcgtatttcatcggatgctacaaaaaggcggccctggtaaagattaaaagggagaatcggtatgcacaccctgaagatgatttcttcctccgatgtggcgaagaggcaaaattcctttccgaggacgacctgaacgggtgcgagcggctggtaagagacatactgcgtttcgtaaggcagaagttctcctacgaggagtaccggatgttcatgctcaggttctatgaggcgcagttctcgttcaaggcactggcggaatgcatgggtatctcggcatcggccatatcgcagaaagtatgcaggatagtggacgcggtacgtacccacagcggtttcgcatggagaagtcagatgctggcggtggaaagcttcatgtattgaaaaaattgtttaacggaaaagtaagaaagttatggcactgatagtatacaacagggaaaactcccgtccgcaggaagtcacatacaagggaaagcggaccatcaaccttgacagcagggggaccgtctatctgtcaaagacgatgtcaatcgaattgggaatcctcggtggcggacgggtgaacttcgcccacgacgacgagacggatgactggtacatctgccgggccgatgacagcgaggggttcattgtctggaaggataaaagatgcgcaaggttctcggcgggggttatcgtgcagagactcatgcggcaggcgaaggtggagaggaagagcgtgcagttcatgatggcgaggatgccggtagagattggcggagtggcctattacaagatactgctctcgaatccgatactcagatagaggcatgggccggaggagtccggctgtatatgacatgacggagacaggtgcatccgacgggacaggagcccggaggatgtgcctgtttttatgcgccgccatgtttacacacggacatgcggttgtcaccggccggcataaggtcactccgaaaagaccgggaaacggcattgccggaggataatgataccagtacggaatgtgccgccattacggaaacggatcgtcccaccggtacacgaacggcccgccccaatttcagaataacataatgacataataaaataagagtctttttttataatggaatccccgtatcttattgccatatcggaaaaatgtttccatgtcccgccatgttatgccaatgttgtcaccggatcataattcataaagaaaaaaacactctgtgtataggtattttacgagcaaattaaagtcgttcatccggtggaaagaaaatgaaggagcgaccggtatgacaaccgaccgccccttcattcacgatcccgtacggaacttttctaaagttcctccggcctggttctcgcctcccggtagcagccgtcaagcagcttctcgatgtcggaagaacggtacagtatcttgccgcccagccgggtgaaggcaagcagaccgctgtcacggtactgttgcaggctgcggcggctcactttcagcttttcagccagttcgcggtccgtatagaagttctcgcccgccatcgccggtgacctgccggcaaagagacgctccatggaaacggagagacgttcgacggtggagaagaactctcttatatgctcgctgctctcacgggtgagcagacggttatcggtattcatcatgacttgatcttttttttgttcgacattcgtttttcatggcctttcagatcgaccttcccatactttcagcccgcttgcggcgctcctccactatccggatgatactttccacgtccccgggcttgtaatatgtcttgtggcagatctgtgtgtatgccagcgtgccgttgtcacggagggtctgcagggttctcgggctgaccttcagcagcaggcacacctcctggttgtccagccatttcttctcctccatgtcgccgtacagccggcagagggtgtccagccggtccgcaaacgtccggaaggccgagagcatcgcctcgaaggtccttgcctcaatgttcactatttccataatcactgtaatttcaggtttgacatctgtttcattctcttttcggatccggattccgttccgcaatttagtgaatcccggcggaacgtcctgaatttcaagacaggatgactacctttgacaccatatgcgtacttgtttcatctgcaaagtaaatgattgttcccggatatggttccgccccttcatcagatgtcattatatgtcatcagatgtcatggaaatcggattttaatattcatttgcttttagtaaacagacgttcagatccgttcccgaagagtgggaaatttccggtgcgtatatttgtgaagtcatcaccgtcagactgatccaacaatatgaataacacggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccgccaatcggacccgtccgtttcacagcacttgttattatcgttttatttgcttccgacaatcgggcaaacgggtagaccgtgcccacagtatcaaccatctaaaatccatgtacaatgaaaagtgaaccgactgaaaaaacgaaagggaagaaaatggcggtatccgaaaccgcagacagaaagaacggccgtagtcccggagccggccacgacgagtggtgggaaagactcatgatggaacccggtccgggggaatccgccggtacggatgcttccgtgacggaatcgatgattccatccgggctcgttgcggaggaggtatccggggaggcgagaagaaaggacacnaccccgccaatcggacccgtccgtttcacagcacttgttattatcgttttatttgcttccgacaatcgggcaaacgggtagaccgtgcccacagtatcaaccatctaaaatccatgtacaatgaaaagtgaaccgactgaaaaaacgaaagggaagaaaatggcggtatccgaaaccgcagacagaaagaacggccgtagtcccggagccggccacgacgagtggggggaaagactcatgatggaacccggtccgggggaatccgccggtacggatgcttccgtgacggaatcgatgattccatccgggctcgttgcggaggaggtatccggggaggcgagaagaaaggacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgccggaaccggaagaccccgtgagaagaagaacgagcggcaggcaacgcagggcctcgctggaggagtaccgggaaacgtacctcaccgtcccgaagatcaggaaccgcaagacggtgttcgtcagtgaggatgtgagggacgaactggacgccgtcgtccgcaggctcggcgggcgtggcatgagcgtttccggactgctggagaaccttgccagggagcatcttgccgcctaccgtggggacatcgagcagtggagaaaaatctgacagcctgttaccgggcgtggagtatacccgatgtatgcactgttccctgtatacccgcttcaatgtggaaaatgcggggggggatttttctgtggggggagcaagggtatgtttccggattcccgaaaacccttgctccccgcgcccggcggttgctgggagggcaaatccgctcccgccggtcgcagattttggaatgaaagaagtacggacgaaaaagaaaaaacatatgacaaacgatgtgaatgggatgaagaaaaaatgtggccgtccggcactgggcaggacgcgtaaattgaccagaggcgtgacggtgaagttctcccccgtcagctacgaggctctcaggttcagggcagggaagtccggccggagtctggcggtctatatcagggaggcagcactggcggccaccgttacggcaaggcatacaccggaggagaacgcactgttgcgcagcctggcgggaatggcgaacaacctgaaccagctgacaaagctctcgcaccagaccggcttttacaggacaaggctgctgatagaggggctgctgggaaagctgaagcggatcatggatgattacaggccgaaaggaggatagcctcatgatagggaagatcaggaaaggccgctcgttcagcggctgcatacgctacgtgacgcagaaggacgacgcaaaaatcatcgcctcggaaggcgtgctgctgggaacggtggaggagacggcacgcagtttccggtggcaatgcctgctgaatccggacgtggcgaaaccggtggggcacattgcgctcagcttcaagccggaggacgcaccgaggctgaccgacgcgttcatggcaaggctggcggaggaatacctggagctgatggggatacggaacacgcagttcatcgtggtgaggcatcacgggacggacaacccgcactgccacatcgtcttcaaccgggtgaacttcgacgggaaggtgatttccgacagcaacgatttcaagcgcaacgagaaagtgacaaaaatgcttaaggacaagtattcgctcacctattccgaaggcaaacagtccgttaaaacggaaaagctgcatgcttccgaaaaggtgaaatacgaaatataccgtgcggtcaaggaagctttgaggagtgcagatacatggaaagaatttcaaaataagctcttaaaaatgggcgtggaaatggaattcaagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccctggaaaatgacgtttcccaaaagcaaccgtaccatgaacaaagtcatggttctgttattgataacctggtcgaagtcaccggtacgggtggcgtgttcatgccgtcggtggcaccgacggaggacgagaaagaggcggaacgcctgcggagaaagaagaagcgcaggaaaggaaggagtttgtgaaccatatgtataacaaaaaactttgaaagatgaaagaggaaaattatctggaaggcatctacggatgccttgaaaggatcgagaagaaagtggagacgctgcccgtggaaggcacaagccccgcagttggaaaccggaccagttccccggaagggattgcggaactgaaaatccgtctggaacgcctgcaatccgcggtggagaaaaacggcttggaaatagcagcggtacgtaaccataccgtccggttgtcggaaggctggccgttgtctgccgaaacgtttgccggggagatggaaaagattagatactgcctgagtcaagactgccaagctgtaaaggagacagtgagacggctggatgagagaatggtcctgctgaaaaaggaaccggagcgcagactggtgacctaccgtctggaaagcgcatccaaggcagtggtaacgacagcttcagcactgatcctggcactgatcatttccgtctggaccaactgcaaccagtaccgcacgaaccggcttttgaaagatgccgatttgaaataccgagccatcaggatctgcctgccgggggatgatcccgacatcgccttccttgagaagcatttcaccatcaagcgggacgaggaaaagatccggcgtgtggaaaggctggtgaccgcttttgaggactcggtcaggaaccgcatccgtaaccatgaaatggcagcctacaaggacagtctggcgcaccggctgttcagggaggcacaggaaatcaggaagcaactggacaatcccaattcaaaatgactgcactatggcaacaatcagaaccaaattcaggtcctcgtccgcggaaggcagggagggcgcactgtattatcaggtgattcataaccgtgtggtcaggcagatcagtaccggatacaaacttttcgcttcggaatgggaccaacgttccgaagcggtcattccctgtcaacaccctgcagggatggaacgggacaattatcttctatcggtaggggaacggataagacgggacaaaatccgactggaaaaggctatcaggacattaagccaatccggtccgtttacagcggatgatatcgtcatacgtttccatgacagcggacaagaaccttcgtttaacgactatatccggcaacagatagtaaggctgaaacgtttgggaaagatacggacctctgaaacctatacagccgcgctcaaaagtttcagcagttttatgaaaggtagcgatatactgtttggcgaacttagctctgacttgctcatggaatacgaggcttatctgaaaaacagggggaactcacccaatacaatctcgttctacatgcgcattctgaaagcggtctacaaccgtgcggtggagaacggactgaccggacagcggaacctgttcaagtctgtttatacaggtgtggaaaagaccttgaaacgggccattcatttaaatgatatcaggcgtatcaaaagactggacttgtccctgaaaccccaccttgatttcgcacgtgacatgttcctgttctgcttttacacacgggggatgtcctttgtggacatggcttatctgaaaaagggagacattgcgaacggaatcctgacttaccgcaggaaaaagaccggacaacagctgttcatccgatgggaaaagtgtatgcaggagatcatcaaacttttttgtttatcggttcaagatttcaaagttgttcattaattgctttgttggttatatccagagtattatttgtaagagactctacgaataaatgatgataagaccagttagtttatcgcttgttttataatttcattgcgatattcgttcggtgtgcaaccttccatcttcttgaaccaacgtgtgaaatgttgcgggtattggaaacccatttcatctgagatttgactgatacttttttgcgtgttcatgatgcgctctttggctatatccataattttttgctggatatgcttgattgctgacataccggtttccttttttaccaggtcactgaaataattggtggaaagacacagttggtcagcgcaatactgtaccgtcggaatacctttactcgttggcaaggcagaatgatagtaattattgagcaacaattcaaaacgcgccaacaaatcgttgttggcattttcccttgtaatgaactggcggtcataaaagcggatgcagcggtcaaggagaagcttcatggtatcaataatcaaagaacggctgtgcttgtcaataggatgcctcaattcttctgctacattgtttatacattcaatgactactttgcgctcctgttctgacaggtgcagtgcttcgttggcattatatgagaaataagaatactcttttattatatgtgcaagggaagtaccgcgcaatagttcgggatggaacatcagggcccatccggccggctggtgcagactgccatcatcgtcagaacccattacctgccccggagcgataaacagcatggagcctttttcatagtcatagaggctccgtccataattcatcgtaccgcagtcagtatctttcagcaacacagcataaatgttgtacagtttctttgagtgtctgatgggctgcacctcgtaacaattcacaacgctgaccaacgggtgcagagcttcgacttcgaaaaggtcgcagtactgctgaactgtatctattcttgttatatctcccataaccatccttttgttttttacaaaaataagtatttatattgacattgctgtctgaggaacagctgtttcttttctatcccttatttattttattccatgacgacaaagttagttcattcaatcaacgaacatataaccctaatcacagactgtcttaccattttcacagataacatttaacccggtccaagcccgatgaaagtggtaattttatcagtgattgaggtctaatcttcagtatgtgaatgctgtaattttgcaagtgaaaccaaaaaggtaaataagatgaaaccaaaagctttatttgtcatgttaatcttatggcttagcttcactacgattcaagcgcggtcaaccgaagatgtcccggataagggaacttatgcaaaatttctgttggtaggatgttatatgaagccagacgaagaaggtgtcagaatgtaccggtttgacggacaaactgccgatgtcgactatccgtgtgggctgagagggatttcaaatcctgctttccttacatctgatagcactggtaatcgaatttatgccataggcgatgatgaagggaaaagttcgactgccaatgctttgctttttgataaggaaagtggtctgctgtctctgcttaactcgcaatctacagacggtgaacttcctatttatattactctcagtccaaaggaatactttgttctgacagcaaattataagggtggcagcatcacggtattctcacaggataagaaaggaaagttgcaacgtgatacaaaaataattcgttttgctggaaatgggccgaataaaaaaaggcaggaacaatcgcatctgcattgcgtgacctttacacctgatggcaaattccttcttgctaccgatttgggaacagattgtatctatctgtttccgataggcaaacgaccggaagcaggtaaggctcattctctgttggatgaatcaagagtagtccgcatacagatggattccggctcaggacctcgacatatatgttttcacccgaatggcagatttgcttatctcatcagtgaactctcgggtaaaataactgtattctcctataatgaaggcaagttggaacgtttacaaacaattgtctgcgaccctttcgttgcagagggaaatgcagatatccatgtttcatccgatggcaaattcctctatgcttccaagcacttgaaagaagatggcataattgtttattccattgattcccaaaaaggaacattggttcaaataggatttcagccaacaggtctttatccgcgaagttttgccatctctccggatggttgctatttggcagtggtttgcagggatgccaactgcatacagatattcgaaagaaaccgaaatacggggttactgaagaatacgggaaaaaatatccgactggaaagaccggcgtttgtcaagttcttataaattcatcactaaacagaaagcaatatgaacaagttaattacaaccatcgcctgcctgatatgctgtatcgtttatacgcaggcacaaaacaagaacaatatgttaagcaagaaagaacaaagtattgccgccatcagtatgtatgccgcacgtggcaatcaggacagcctcaaagtgatccttgccagaggacttgactgtgggctgaccgtgagcgaagaaaaagaagtacttacccagctctatgcctattgcggctttccacgcagcatgggtgcattggttacgctgatgaatctcaccaaagagcgtgcagcacaaggcataaaggatgaagccggacgggagccttctccggtaaagagttcggatatgtttgttgtcggtggacaaaaccagctgaaactgttcggtcgtccggcactaggagaagtgctgacatttgctccggcattggaccaatttctgaaagctcatctgttcggtgacatattcagccgtgacaatctcgactggcgtacccgtgaactgtctactgtggctgccttgtcggtgttggacggcgtgaagaatgagttgaatactcacattgcccatgccaagcacaacggcgtgacacaggctcagatagacgaagtacttatcatggcggcacgctgtcggaacggaatggtgctttctgaatccgatgaaccggcaaagacttttcaaacagatccgacaattactgtccgtaaggtcttttataaaaacaggtatgatatcatgctttgcgccgaaatgtacctcccgaaggatttcaatgaagcgcaacactatgcagccctcatcatcggacacccgttcggggctgtgaaagaacagtgtagcggactctatgcacaggaaatggcacggcgaggctacgtgactctggcttttgatgcttcctatcaaggcgaaagtggaggagaaccgcgtcacacggtatcgcccgacgcattggtggaagacttcagtgcttctgtagactggctcggactacaaccgtttattgaccgcaaccgtatcggtgtgattggcatctgcggaagcggcgggttctctgtctgtgcggcttctctcgacccccgcatcaaggcattggcaaccgtgagcatgtatgatatggggcgtgccacccgtaacggtttgggggattcgatgacggatgaacaaagacgcaaactgttggatgaagttgccgaacaacgttggaaggaagcagaaacgggagaagcacgtatccgctttggcacaccggagaaactgctgggaaatgccaatgccgtgcagaaggagtttttcgattactatcgcaaccccttgcgtggctatcatccgcgctatcaaggtatacgctttaccagtcaggcggcattgatgaacttctatccgtttgccatgattaaagagatttcaccacgccccgtgctattcattgcaggcgagcatgcacattcgcgctatttcagtgaggatgcctatcaagaagccagcgaaccgaaagaactgtatatcgttcccggagccaatcatgtagacttgtatgaccggatggataagataccgttcgaaaaaatttcggaattcttctggtatgctttgcggtaattcagatgaaaatggtaatgctatccgtgattatgatacagcaaagcgaatacgcaggagggtaactttgcaacagaaacaatttaaagattatagtatttgcaaccagttattactcaatattttgtgagttataagtcagaaatatgggcataacctttaggggtacattctaaaaggtgaagatttaacctttttattatttcttaacactcaaagagcggtggtagagggtattttccctcttttcggtactttattgatggttcgatgttcccatctttccacattgcttggctcgttcgcacaagccactacaaaggtactacaatttccaataaaggcaagaggacagcaattcaaatctattatttttgagggagtgaaatctgccgcttgccaaatttctctctgtcgaaaataatagtcctctgaaaagaatgaaaacagcattgataaaattgccttattaagggggggctatgctgttttatgctattatttcgtcagtcgtttatctccgttgccggatgcagttttcagccaagccgatgaataagaaaaggttttggagctgtttactctccaacggaggacgaaactgctccaaatggtttaccgcttgaacttttcgttttctaaaagaggtttggcaacctttgcatccgacaaaaggagataaatgaccagatatataacagtagtattacattaaggtaaagaacaaccatggtatagtattattgcaatttaactatttaaagtttgtttataatcaaatcatttaaagatttttgtccttctatgattttttgtgtttgataaatgtcgtaattaaataaaaaatatcacgcataatgactttttcttttttctaaatttcttcaaatccttgcagaagctccaccgtttccgatttaccgggcattccgggatcattctccaccaaacgcagcaatcccctccagtcacgccccacgaataccgacgttttcagcgtgtcgggtagcggcgagtaaccgcacacgtgatcgaacaaacgtttcgcccttagttcagacaaacgcctgttcagttcgatgctcccctcgggggacgccgcaccgaccaccataatcttgcagatagagaaagccgtgtccggcctgtattccaatatccggcggctgatcttctctaacgaccgcctgttatcccgtaaagagagatctatttccgttctacccttgtggaaatatattttcacggaatcccgtgtctcttgagcggaaacgaaaagaacggaacacgataaaaaagaaaggagaattaccttgaaaagtcttaaatataggtttctacacacactcgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatacttttgaaacctaatattttaattataaattctatacttacaattttgaaagccgcaaagatacatcatttttcgaaattaacagttaatacgcaatattttctacataaagatacaaaaaaagaaagcgatatcggggcgttacaccataaaaacaacctatcggttattataaaatgatattgcgcacccggctgatcggtacggttctcccaccatgcggacaacattaaggtactgcaaaagtatcttttcatctgcaaacaaggatgttcaaaaagaacttggtatttcataaacactgaatttaagataatagggcaaaaaaataaaaggttcgtaaacccttttagccaacaatttgttatctttgtgcggtcgtaaaccgaccgtgtttttacattttgagaaaaaaagcgtttagctgatttctgtgcaagcgaaaagtccaaaaattgcattatacacagagaaacagataaatgctccccgtgatatgcggggggtatctcctgtttgtgtgtatagggcttggactccctcgcttgcggataggcgaatgcccttccgctttttttatgtttattggcttggtgtagggcacaagcgaaatccttatagcaatggaaaagacacagcgaaaacagtccctaaactgcttgtcaaacactcctaagctgtttgacctcaaagaactacttagttcgcttaagatcacccccggacaaatgggaaacatgaaagggttgatatacatcgaagggctgacggaaaaacaagtacgccaaaaattaagccatgcaaagatcatcggaacaaatagattcggcattaattcctgcctgtattatatcttctttgaggatgtaaaggggagatatttgtgcctgtttaacggtgacagggaatgtttcagagcgttgtttttcagtaaggtattactaaattaaccccctataagatagagttgtaaagttcttttcatccgcaaaatgaaatgaatagaacgtaatatctatattgttaaaatttattaacggggtaaattctaatttgtatttctacacgctttgaataataaaatatatacatatttttgaaccattaaaatataaactttatcatggaaaaagcaaatataggatttaaagccgggatcatctttgaaaaattaggagaaaccggacttataaccattgccgagcttgcgagaaggctaaattttgcggctgatgaaaccgcactcgccgccgggtggctcgcacgtgagaataagatatacatcgaacggcgaaacggtttgctgtatatcaggaaagagtgatacaacgtatcaaaaggataaacgataaacgctggaatgtttgcagtgcgtaacactattgatgtaaaagtgcttttcattatccatttgaaaccatttatcaatttataacaaataacaaagtatggataagcacatcatcggagagaacgcagggaaactctggcgcttattaagcacagacgtacaccgaaaatggactttacaagaagtcaaggatgcaacagggttcaatgacctggaagctgccagcgcaataggttggctcgcacgtgaggacaaaatccaattcgaacttgaacaccacagcactaaggataagaacgtctttttataccttatgctgaacgtgtatttttaaagcctgtttaaaaatattgcccccggcggggttttcgctgggggcttcctgcatttgcatatataacctcaaaggcaagtcaaatcggacggggtggcggtcggacggctgaaaagtcgaaaacgtaacacaggcgtgttactacttgtctttgacaaggcattttttaggggtgctggcatacaatccgaaaggggcgggaacggctgttcccgtttgttctccctgcaacctacaggatattaaccttaaatcattaagtgataaacactatatttaataaacccttttagccaacaaattgttatctttatgcggtcgtaaacaaaaaataagcttatgaaaactgctatggaaaaaaaagaaatcggcttaatgagacagatcggttatctctcttttgtcgttgttttgttgtatgggcttacgctatttgcggtttcttgtgacaatgatgaagatcctcctcttcctcccgcagtggaaaaagtagtgctggcatttggtgtggatcagggtgaaggtcagctttcggctaaaccggagttggaaaatacggctgcggaaaagataggagaattgatctctccggctgaaatagcgaaaggcacaacggtgcattttcgtgctacccattccaaatcatggacaatcatgtattggaaagtcaatggcgtcattattcgttctgtggagccggagcagactttcgtcatcgatgagcataaggaggttcgggttgctttcaagccttacaagtcaccggaaccggaggggctgtaaaacaaactgtgtcagcaaagcaataaaatattaattttgctgacacagtttaattgaattctctttttgctgttcatttgctttatttcaggacttcgcccttctcgttgaagaacacttcgctgtccgtgccttctgcatcggtaaatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgccactgaactacccaatcccataacaagtgctactgcaaataatacctttttcataatccaatctatttaaatatttaacatatggtttctgaaagacaaagaacaaacattgtgccaaacaaataaacaagtcatatatacctgataatcaaaagcatacaaaaaacacatatatttattgaagaactgttatctgtgtatcatttccacattttgtggaaatgatacacagactttctataattgcctccggcggggttttcgccggggggcttcttgcatttgcatatctatcaaaaagaaagcaatatcggagcgttacaccataaaaacagcctgctggcaatgacaaaatgatattgcgtgcctggctgatcggtgcggttctcccaccatgcagacaaatcccggtaacagaatgacaaagcggacacccaaaattgcgttagggattgcagagtaaagcccacagcctttaggcgaggacttggagcgtaaagcccgaccgtcccacgggaacgcccaaaagaaaaagaatcccccgaacattcatccgggggacattcaggccgtcacgtcaattataatacagattaagatcatccgtacttatctccttcccgtcccggaaaacaaggctctttttctcgatctcctttccgtttttgtaaacggtcactacccactgcatcggctcgttcacaacgccgtcctctccgtccacgacaccaccggaaacgtacatacagtatacaagaaattatatgtgagataattagaataaacaaaccaataaatacgatgaaaaataattttacatggtttttactgtgccttgcatgtatgatgacgctctcttgttccgacaagaagaatactgcagatgaatcggagaaaggcgtctccacagtccttccagatacgaagaatgaagtagctgttcagatattgaagaagcgtgattttcatcacgaactggtgagtaacggcaaaatcagtgcccgtggcaaagccgatctgcgttttgaaaccggtgaagtcatcgctcatatctatgtgaagaatggcgaccgtgtacagaaagggcagaaactggctgatctggataaattccgtctggaacagaaattatcccagtcggaagatgctttactgaaagccgaacttgaattgaaagacgtactgatcgggcagggatattctcctgacgactttagtaaagtccctgccgaaacaatgaaaatcgccaaagtaaaaagcgggtatgaacagtcgaaatcccagtatgaactggcgaaaagagagatggagcatgctacgttgattgctccttttgacggtgtagtagctaatttattttcaaagccttataatccggcaaatacttctgaagcattctgtactattatcgattccaaaggaatggaagctgatttcacagtgctggaaaatgaacttgcttttatcaggatgggagataaagtggtaattactccttatgccggaggagatgcgtttgaaggcagtgtatcagagataaatccattggtggatgccaacggcatggtgaaagtgaaagcattggtaaatgcgggaggaaaactgttcagcggaatgaatgtaagggtaagtgtccgccgttcgctgggagagcggctggttattccgaagagtgccgttgtattgcgttccggcaaacaagtggtatttaccctgaaagacggcaaggcaatgtggaattatgtgaatacgggactggagaatgcgatagaatgtgtcgtctccgacaagtcacagaaaggtatcgaggatggtctgctggaaggagatacggtgatcgtcaccggaaatctgaatctggcgcatgaggcggaagtctatgttaaatgaagaattaagaattaaataatgaatctatgataaaattcttaattcagcgccctattgccgtattgatggcctttaccgcctgtttcatcatcggactggtgacgtactctacgctgcctatatcgctgcttcccaatatcgctattcctgagattacggtacaggtggcgtctgccaatacctctgcccgggaattggaaaacacgattgtcaaacctttgcgggggcagttgattcaggtctctaccctgaaggatattcatagtgaatcgagagacggggcgggcattatccgcttgtcatttgaatatggaacgaataccgaccttgcctttatcgaggtaaatgagaagatagatgccgccatgaactatcttccgaaagaagcggaacgcccgaaggtaatcaaagcgagtgcaacggatattcccgtattctatctgaatctgacactgaagaatgacagtgcttacggagctacggaacagcactccttccttgaattgtgtgagtttgccgagtctgtcatcaagcgcaggatagagcagcttgaagaagttgccatggtggacgtgaccggaattttggaacggcaagtacaaattgtgcccgacaaggacaagctcgccatgatgggactctccattggagatatcgaatcggctttatcctctaataatgtggaaccgggcagcatgacagtgcgcgacgggtattatgaatacaatattaaattctcgacattgctgcgtacagcggaggatgtggaaaatatctatctgcgtaagggcgaccgcatcgtacagttaaaagacttctgcaaagtaagcgtcgtacctgtaaaggaaaaaggagtatccctgtccaatggaaaacgggcggtgagccttgccgtcatcaaacaggcggatgagaacatggataagatgaagcaggcgctggttggcacgatgacctattttcagttagtatacccggagatcgatttcagcatcagccgtaatcagacggaactgctggactacaccatctctaatctgcaacagaatctctccctgggctttctctttatttgtctggtagcggttctgtttctgggagatgtaaagtctcctttggttatcggactcagtatggtggtgtccatcgtgatcagttttgtctttttctacctttgcaatatgtctctcaatatcatttcacttgccggattgatcctggcattgggaatgatgattgacagttcgattattgtgactgagaatatatcgcaataccgtgaacggggatactccttgcgccgtgcttgtgtgacgggaaccagtgaagtggtcacccccatgctgagttcttctctgacaactattgccgtctttgccccgctgatttttatgagcggtattgcaggcgctattttctttgaccaggctttttccgtcactgtaggactgatggtgtcttatctcaccggtatcatgctgcttcccgtgctttatctgctggtttaccggacaggtgtccgcacccggaaatggaagtggctttctttcaaatttaataacccgatcaaggatcacacgctggaccgcttctatgatgcgggtgttgactgggtatttcgccataaaacgttcagtgtactgttctgtgtgatttccattccgctttgcgtattcttctttttctttatagacaaagaacggatgcccgatatcgaggaaaatgaactgatcgcccggatagaatggaatgagaatatccatgtggatgaaaacaaacgacgggtggatgaacttttcaaggaactgaaagatgaagtactggagcaaacagcctctatcggcagacaggatttcattctcaatcgggaacgggaactgtcttcttccgaagcggaactttatttccgtacggagacttccaatgctattgcctctttggaacaggcggtataccggaaactgaaggaacgttatccgctctctgtcatttctttctctccgccggaaacggtatttgagaaactctttgtgacgggtgaaccggatgtggtggcggaattttacacccgtaataaagcggaagcccccaaagcggaagcaatccgtagcgttgaacaggaactgggacgaaaaaccggaatcaatccgacaggtatcgccttcgaaaaccagttgaatctgagtatcagcaaagagaaactcttgctctaccgtgtttcctacaacgaactgtatcgggtactgaaaacggctttccgggaaaacagtgtgacgatgctgcactcttatcagcagtatttgccgatcaacattgccggggatgaaaagactgtgaacgaggtgttgcaggaaacactggtgcagacgcaaccggacaaccgtgggaatgtcgattttatcccgcttcgggaattgatcaacgtagctcccgccgaagacttgaaaagtattacttccggacgtaacggcgagtatgtcccgttcgacttttacggcgtgcaggatgcgaaccggctgatgcgtgaagtgaaacaggtggcggaggaaacaggggactgggatacgggcttctccggcagtatcttctccaacaaggagatgctggatgaactggtcgtgattctgttgatctcactgctgctgatgtatttcattcttgccgcacagttcgagagttttctgcagccgttgctggtactggcggaaatcccgattgatgtggcatttgccttactcttgctttggatatgcgggcatacgctgaatctgatgtctgccatcggtctgattgtgacctgtggtattgtaatcaatgactctattctgaaactggatgcgatcaatgaactgcgcaaggcaggcgttcctttgctggaagctattcacgaagcaggccgcaggcgtctgcgtccgattatcatgacttcgctgacgaccatctttgccatggtgccgttgctgttctcctcggatatgggatcggaactgcaaaagccgttgtctatcgccatgataggcacgatgtccatcggtacggcggtcagcctctttatcataccgctgctttactggtttatctatcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgaaccagactatcgctttagctaacgacagttcgctggagtcattccgcacacaaaatatgtatctgtccggttattgggaataccggacgtaccgggcaaaccgtttgccgagtctgacaatggaccttaccccggcacaatataaccgggatatcacgaaacgttatgattcgggacaggacctggatgtctaccgtacgcaacagtcatattatgcctatggaggattaagtgtccgtcaaaatctggacctgaccggaggtacgttctatctggagtcgaaccttgcctatatgcgtaatttcggggataatagtgcgacacagtttaccagcgtcccgatacggctcggttattcgcagagcctggtcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggcggaatacaaactggcaaaggaaaacctcgcatctacggatactttgtaccgcatcggacagcaacggcaccggatcgccgctatttcacaggcggacctgttgactttaaagctggataaagtgaatgcacagaatacattgcagaatagggcaagcgccttgaaacgggcaatgttctcactggcatcttttctgaatctggataagaatacccagatcgaactggagcttccttcacgcccaagtatgatggagattccggtggatgaggctttgagatggggaaggagcaataatccgcagttgctggaactgaagcagaatgtactggaagcggagcggaatgtggacagaacaaagaaggaatcccgtttcaatgccagcgtgaatgccagtatcggtttcaaccaggtggcggaaaacttcggagatgtgtatcataaaccgatgcagcaggacttggtagcggtcagcgtatcgattccgctgctggactggggcgttcgtaagggcaaatacaacatggcacggaataatctgaatgtagtgaagatttcggcacgtcaggatgagatcagtattgaggaggaagtcatcatgacggtgagtgattttaatatccagcagcagttgattgccagtgcggaagaagcgctggacctggcgatactggcttataatgagacaaggcaacgttttattatcggtaaagcggatattaatagtctgacgctttcgctcaacaggcagcaggaggcgcagcgcaactacatttctgccttgcagaactactggctgaattattataaaatacgtcgtctgactttattcgattttgctacgaagctttctctttcggatcgtttcgactttaatggaggaagactgattagatagtaatttcttttgggatatagacaaatgaatcatgcaagatataggttctgaaattaaaaagtcatcaaaggcttccgcttttacgctcattgtcgcttttatcagcgtggcgttggtcgggctggcacttgttccgttgctgccggtgaagctgaatccgtcacggaccttacccggattttctgtatggttcggcatgggagggacttcggcacgtgtcgtggagatgacggctaccagcaaactggaggcgatgcttgcccgtgtcaagggaatacaaagcatatcttcgacttccggcaatggctggggaagtataaatgtgagtctggacaagcatgcagatgcggctgtcgcacgttttgaggcttcgaccatcattcgtcagacttggccggaattgccggcgggagttagttacccgtacattcagatggcaagtccggagcagaaaagtcagggaccttttatcgcattcacgattaatgcgcctgccactcccagtctgattcagaagtatgcggaggaacatataaagacacgccttgcgcagcttccgggaatctataagataaacgtcagcggagccacaccgatggaatggcgtctggagtatgattatgagcagttgcgtgcgttgggggtgagtacggatgaaattagtcaggcagtcggtctgcattatcagaaagagtttctggggacttatgatgtggaacaggcggcttcgggcaaggaatggattcggttggtgctgatgcccgaacatgataaccgggagtttgacgccgggcagatacaggtgaaagtgaaggatgggagaaccatccgcttggacgaactggtgaaggtcgtccgtatggaagagcagcctcagagctattaccggatcaatgggctgaattcgatttatctgtctgttgtcgctgaagaggcggctaatcagctggaactgagcaaaaaagtacaggcgtgtatggatgatatcagactgtcgcttccggcgggatacgagattcataccagttatgatactacagagtttatacatgacgagctgaacaagatttatttgcgtacgggagtgacggtggctatcctgctcttgtttgtactgctgattactttcagccccaaatatctgtttttgattgtcaccagtctgaccgtgaatatggcaatagccgttatcttttactatgtcttcggactggaaatgcagttatattctttggcgggtatcacggtttcactgaacctggtgattgataatacgattgtgatgagtgatcattatcttcgatgtaaaaaccggaaggcgttcatgtctgtattggcggctacactgacaacaatgggagcgttggtcatcatcttctttctggacgagaggattcgtctgaatctgcaggattttgccgcagtggtgatgattaatctgggagtttcattattggttgctctgttctttgtaccttctttgattgataaaatcgggttgaaacgacgcaggaagtcttctctgaccggagtgaagagaaaatggaaaatggggaatacccgtttcttaggatggctgcgttcgaagatgcgaagggggccggtctatttcagtcatttctacaggtggctgatacagaggctttgccgctggagagtagcggtttgtctgttgctgttgctggcattcggattaccggtctttctgttgccggaaaagatggatggggatggcaaatgggcagagatttataataagacactggggactcctacctataaggaaaaggtgaaaccgatagtggataaagcgttgggaggaagtctgaggctgtttgtgcaaaaggtgtatgaagggagctactttacccggaatgaggaggtggtgctttatgccaacgccaatttaccgaacggcagtacgcttgaacagatgaatgcactgatcaagcgaatggaaacttatctgagcgagttcaaggagatcaagcagtttcagacatcggtagaaagtgcccgcagggcatctatcagcattcgtttcacaaaggaaaatcagaaaagcgggttcccatatacgctgaaagctaacatgatcagtaaagctctccagttggggggaggagattggagtatttatggattacaggatcagggattcagtaatagtgtacgcgagaatgcgggatcattccgggtgaaaatgtacggatataattatgatgaactttatagctgggctacaaaactgaaagaggtcttattgtctcatcgccgtatcagggaagttacggtcggttccaatttctcgtggtggaaggatgattatcaggagttttattttgagctggataaacaacggatgatcggagcggggatcggagccggagaactgtttgctgctattcgtcccatatatgggcggaatcaggaaatcggttccgttgttaccgaagatggaacggaaaaaatcaaactctcttcccgccagtcggatcagcgggatatatgggccatgcagtattatcctttccgtgtaggcgataaagagtataaactggcggaactggctaaggtagagaagggacagatgccgcaggaagtggcgaaggagaatcaacaataccgcttatgcctgcaatatgagtatatcggtgcgtcggaacagggaaataagttgctgaaaaaagacctggaagagtttaatgaacttcttccgatgggatataaggcggaagcggaaagtaataactggtcatggggtggaggtgccaacaaacagtatcgcttgctcctgattgtgattgctatcattttctttattacaagcattctgttcaattcgttgaaacagccgttagcgatcatctttgtcattccgatctcttatatcggtgtgtttctgacgttctactggttcaagttgaactttgaccaaggtggtttcgcttcgttcattctgctctgcggtatcacagtgaatgccagtatttatattttaaatgagtacaatgcgattcgaaaacgctttccctgcctttcttctcttcgtgcttacgtgaaggcatggaatacgaaagtgatccccatttttctgacggttgtttctaccatccttggctttatcccctttatggtgggagcagagaaagaaggtttctggtttcctttggctgcaggtactatcggtggattggtaatgtccgtgatcggcgtgtttattttcttgccggtactgactttgaataaaaagaagatgatggtgaagaagccttgaagaaataaattagctattagcatatttcgattagctaatagctaatttgtttttgctaatagctaatcgaaataaggtataggagataattcaccagttatttcctgcattgctgctgccgatcagcatttctacccgttgcttatacaagttggctccctcagcgatgttctttcccgcatctgcggttcccattccgtaaacaacaacaggcgtttgccacgacatccccgaatgaatggcactaacctgataaggacgtaaaagctcatccactgtgaagcggtttctgcctccgctacggtatgcttcatattcggaacctgtggtggttactactgtcaatggtttcccggctactgccggagtcttggaaaggaaggtgaatacttcgtcctgccattttttgagcaatgacggcgcagccatccaatgaaagggaaattgataaatgagggcggaagcatcggaaatgattttgctccattcgtcaacatcaaaagaagcgccttgctggtcgtaaagattgaatactgctacgccttcaatatcactcacagcatcaatcagtgctttgtttgcttgtgattccttcatattgggatgcgccaggagaatcaccacttttcttaaatctttattcataatcaatcgggtatttaggatgaaacaactacatctataatataaaggtctaaaaataagaaaaagttttcgaaactcaatatcttaattaaaaataaaagaatctctctttgcttttgaatttgtatttttgcaggcacgtccgtaaggcgttattttagataataaatttatatatgatagatttcacccaatttccttctccttgctatattatggaggaagaactcttgcgaaagaacctgtgtctgataaaaagcgtagccgacagggcaggagtagagattattctcgccttcaagtcattcgccatgtggcgttcatttccgatattccgcgaatacgtggagcattccacagcaagttctgtgtatgaagcgcgtctggcattggaagaatttggaagtaaagcccatacttattctcctgcgtatacggaacaggattttccggaaatcatgcgttgcagcagccacatcacttttaattcaatggcacagttccgtcgtttctatccgatgacagtggccgaaggaagcggaatctcctgcggtatccgtgtgaatcccgaatattcggaagtagaaacagaactttataatccgtgcgcacccggtacccgtttcggaatgaccgccgacttattaccggataccttgcccaaaggaatcgaaggtttccattgtcattgtcactgcgaatcttcttctttcgagctggaacgtactttgcagcatctggaagagaaatactcccgctggttcccgcaaattaaatggctgaatctgggaggcgggcatctgatgacccgaaaagattatgatacagaacatctgattaaattattgcaagacctgaaagcacgatatcctcatttgcagatcatccttgaacccggttctgcttttacatggcagacaggagtcctgacttcggaagtggtagatatcgttgagagtcgcggtatcaagacggctattctgaatgtgagtttcacctgccacatgcccgattgtctggaaatgccttatcagcctgccgttcgtggtgcggagatggggaatgaaggagaatttatttatcgtttgggaggtaattcttgtttgagtggtgattatatgggattatggagtttcgatcatgagttgcagatcggagaacggattgtgttcgaagatatgattcactatactatggtcaagacaaatatgtttaacggaatccatcatcccgccatcgctttgtggacaaaagaagggaaagcggaaatatacaagcaattttcttatgaagactatcgggaccgaatgagttgataatcaaaacaattgtttgtttgcggaaacaaagtgtgcagattcttgtgaaaaaaagatgcagaatgtttgcagaattacggaaaatccctacctttgcaaccgcaaacgaaaaaatgcggaaatagctcagttggtagagcataaccttgccaaggttagggtcgcgagttcgagtctcgttttccgctcatgtttctttgaaatgttggaaatataatctttgcccaggtggcggaattggtagacgcgcacgtttcaggtgcgtgtgtcgagaggcatgcaggttcgagtcctgttctgggcacaaagattttaactttaaaattctggagaggtggcggaattggtagacgcgctactttgagggggtagtgacagttatgtcgtgggagttcgagtctccttctcttcacagtcattaaagttatttgcggaaatagctcagttggtagagcataaccttgccaaggttagggtcgcgagttcgagtctcgttttccgctcatgtttctttgaaatgttggaactaaattttgcccaggtggcggaattggtagacgcgcacgtttcaggtgcgtgtgtcgagaggcatgcaggttcgagtcctgttctgggcacaagaaattcagatttctgaatggagaaaatttagtttgcggaaatagctcagttggtagagcataaccttgccaaggttagggtcgcgagttcgagtctcgttttccgctcaaagtagtgaggttgtcagtcgataagattggcgacctctttttgtaattacgaaagtcgatgtacttcccccaaaaagagtgtcatcgactcacacagacctataattaatttaagaacttgtgatatgttaacacaaatcattaatgcgcgcatcctcacccctcagggctggttgaaggatgggtccgtacttattcgtgatcataaaattctggaagtgactaactgcgacctggcggttatcggagcaaaactgattgatgccaagggcatgtatatcgttccgggaggagtagaaattcatgttcatggcggtggtggaagagactttatggaggggacggaagacgccttccggacagcgattaaagctcacatgcaacacggaactaccagtattttccccacactttcttcttctactattcctatgatccgtgcagccgcagaaacaactgaaaagatgatggcagagccggacagtcccgtactcggcctgcatctggaaggacattacttcaatatggagatggcaggcggacagattccggagaatatcaaaaatcctgatccggaagagtatatccctttgctggaagaaacccattgcatcaaacgttgggatgcggcaccggaacttccgggggctatgcagttcggaaagtatatcaccgcaaaaggcgtattggcatctgtaggacatacacaggctgaatttgaagatatccagactgcgtatgaggcaggatatacgcatgctacacatttctacaatgctatgcccggatttcacaaacggaaggaatataagtatgaaggtacggtagaaagtatttatttgattgatgatatgacagtggaagtcgtggccgatggcattcatgtgcctcctaccattcttcgtctggtctataagataaaaggagtggagcgtacgtgcctgatcactgatgcgctggcttgtgcggcaagtgacagtaagactgcttttgatccgcgtgtcattatcgaagacggtgtgtgcaaactggcagaccgctctgcattggcaggaagtgtggcgacgatggaccgtctgatccgtacgatggtgcagaatgctgaaattcctttggcggatgctgtgaggatggcttccgagactccggcccgtatcatgggagtgctcgaccgcaaaggtacgttggaacgtggcaaggacgcggatattattgctttggatagagatctgaatgtaagagcggtctgggcgatgggacaattggtagaaggtacaaacaagctgttttaacgactaaaaaagaaaacgatgttaactcaaataatcaacggtagaatacttactccgcaaggctggctgaaagacggctctgtattgatttgtgatggaaaaatattagaggtaaccaacagtgatctggcagttatcggtgcaacagtgattgatgcgagaggaatgacaatcgtaccgggatttgtcagtatgcatgcgcatggtggcggcggccatgattttaccgaagcaacggaggaggctttccgtatcgcagcaactgctcatttgaagcatggagctaccggcatatttcctactttgtcatctacttcgtttgagaggatatatcaggcggtcgatgtttgtgagaagctgatgaaggaaccggagtctccgattctcggtctgcatatcgaagggccttatctgaatccgaagatggcaggaagccagtatgacggttttctgaaaactcccgatgaaaatgaatatgtgccgctgttggaacatacttcctgtatcaagcgctgggatatcagtcccgaattgcatggggcacatgattttgcaaaatacactcgttccaagggaattatgacagccgttactcatacggaggctgaatatgatgagattaaggcagcgtatgcggtaggattctcgcatgctgctcatttctataatgcgatgcccggttttcataaacgtcgcgaatataaatatgaaggtacggtagagagtgtatatctgacagatggaatgacggtagaagttattgcagacggtattcacttgcctgctactattctgaaactggtttataaactgaaaggggtagagaatacttgtctggtgactgatgcgttggcttatgctgccaatgaagggaacgagccgattgatccgcgttatattattgaggacggagtatgtaagatggcggatcattctgcattagccggtagtctggcgactatggatgtgttggttcgtacgatggtgaagaaagcaagtattcctttggaagatgctgtgcgtatggcttccgaaactcctgcccgtctgattggtgtgagcgatcggaaaggggcattgtctaaaggtaaagatgctgatattgtgatacttgataaggaattgaatgtacggtgtgtctggtcgatgggaaaagttgttccggggactgatagattgctgcataaatgataagtgctatctgttaaatctgaaaatagaaagtccgaacctttaaattgcaaaaagcaattgggattcggactttttcagtaagaaaagtagtaatgtgagtactctatattctattttatcatgaaaatagagtcgtttctataaactctttcaattgaaccttattcattgtaccgagtttcattatcggtttgccattcaccgggcaaagcaaaaggttgggaattgtccgaatcttgaatgcactttccagttcctcttcctgatcgacgtctactttataaatgtccagtctccctttatattcttctgctaattggtccaatatgggtgataatgccttgcaataaccacaccatggagcatgaaaatcgactaaacaaggtttattccctttatattcccaattatccggataagattgataatcagcaactttctcaacaaagctttctttggttaaatctataattttcatatttcctgtttttaatgattcattatttatttctactttgcaaagataggggtatggtagagaaagagggatagccattcttcctgttgtgtttacaatttttcctttccttagatattttctaatcaaattctaatctgaaatgagagccttataatcgcttttatccagcctctaccgttgcagagttgtacttttgtcggaaaacaaattaaggtaacaaaaagattgcgatgaacagagcatttttatttttactatttcttctattggcaggaaagatgtgtgcgcaacaggttgcaggcacattgacactgaaagaagcagagcagcgttttttagagcgcaatttatcgttgatagccgagcggtacaatatcgacatggcacaggcgcaggtattacaagccaaattgtttgaaaatccggtcatttcgctggaacagaatgtctacaaccgattgaacgggaagtattttgattttggaaaagaaggggaagctgttgttgaaatagaacaggtgatccatcttgccggtcagcggaacaagcaagtccggctggaaaaaatcaataaggaaatagctgaataccagtttgaagaagtaatgcggacgctccgtcaggaattgaatgaaaagtttgtagaagtctactttctttctaagtccattgccatctatgaaaaggaagtaaattccctgcaagtacttttgggcggaatgaaaattcagcaggaaaagggaaacatctctttaatggaaatttcccgtctggaatccatgctcttctccttgaggaaagagaagaacgaacgggagaatgatttactgactaccaggggagaactgaatttattactgaaccttccggaagatacacaagttcaactctcattagacgaagaagtactgcaacaactggacctgtcgcaattatcatttgcagacctgaaagcaatcatcaatgaacggcccgaccaaaagattgcccgaagcacagtgaatgcctcccgtgcaaatctgaaactacagaagtcaatggcctttcccgagttctctgtgaaagggaattatgaccgtgtaggaaactttatcaatgactatttcgcgataggagtaagcctgtccgtacctatcttcaaccgtaatcagggaaatatcaaagcagcccgcttcagtatccagcaggcgggagtgcagcaggaatatgctgccaatcgtgccgatatggaactcttcaccgcttatacgtctctggagaaagcgactcaactctatcaatccactaatatggacctggaacgtaacttcgagaaattgatcacaggagtcaatgagaatttcaccagaaagaatatcagcctgctggaatttatcgactattatgacagctataaagaaacctgtatccaactatacgagataaagaaaaacgtatttctcgctatggaaaacctgaatacagttgtcggacaaaatgtattgaactactaataaaccgaccaatatgaaacgattaaagatcacaatccataaattatcaaagactatgaactggaataaatttcttccttgtatattgtttggcagccttttgggagcatgctccggaaaaggagaacaacccaaagtagaaccgactacactatgcctgacggacagcctgctgagaatcgtatccgtcgataccgtgcacgtctgtgaagtggtagatgaactgacattgaatggacgggtcactttcaatcaggatcaggtggcaaatgtgtatccgatgttcggaggaaccgtgacggaactgcgtgccgaaataggagactttgttcacaaaggagaagtgctggcagtgatccgtagcggggaagtggcggattatgagaaacaattgaaagaagctgaacaacaactcttgctggcccggcggaacatggatgccacacaggatatgtacacttccggcatggcatcggataaagatgtacttcaggccaagcaggaactggcaactgcggaagcggaagaaagacgaatcaaagaaatattctccatttatcacttctccggaaatgctttttatcagctcaaatctcccgtatcaggctttattgtggaaaagcagattagcagggatatgcagctgcgccccgaccagggggatgcgctgtttacgatttccggtctgtccgatgtatgggtgatggcggatgtgtatgaaagtgatattagtaaggtttccgagggagctgatgtccgtatctcgactttggcatatccggaaaggacatttacaggtacgatcgacaaggcctatcacctgttggacagtgaaagtaagacaatgaacgtacgcatcaaactgaaaaacgaggattacttgctgaagccgggtatgtttacaaacgtgagcgtgaagtgtaaagcggaagatacttccatgcctcgtatcgactcccatgcgctggtgttcgagggaggaaagaattatgtggtcacagtagagcctgaccagcgtctgaagataaaggaagtagacgtttacaaacagttgagcaaggaatgttatgtccgttccggtctttccgaaggagacagggtactgaataataatgtattgttagtgtataatgctttgaatgcggattaaaaatcagagaatagtatgcataaattcatagataatatagtagccttctcgctgaagaataagttctttatattcttctgtacggtgattgccgttatagccggagccgtctcattcaaacatacgccgatagatgcctttccggatgtaacgaatacaaaagtgacgatcatcacgcaatgggcgggccgtagtgcggaagaggtggagaaatttatcacgattcccattgagatagccatgaatcccgtacagaaaaaaacggatattcgttcgaccactcttttcggactttctgtgatcaatgtaatgttcgaagatcgtgttgatgactttacagcccgtcagcaagtctacaatttgctgaatgatgccgatcttcccgaaggcgtgactcccgaagtacagcctttgtacggacctaccggagaaatctatcgctacaccctgcgcagtgacagacgtagtgtacgcgatttgaaaacgattcaggactgggtgatcgaacgaaatctccgttcggtatcaggtgtagctgatatcgtcagtttcggtggcgaggtgaagacattcgaagtgagcgtgaatcctcatcagttgattaattacggaattacctctctcgaactttatgacgcgatagccaagagtaatatcaatgtaggaggagatgtcatcacgaaaagttctcaggcatacgtagtccggggaatcggtttgataaacgatctggatgaattgcgaaacattgtagtgaagaacatcaacggaacgccgattctcgtaaagaacctggcagatgttcacgaatcctgcctgccccgcctcggacaagtgggacgaatggatgagaacgatgtcgttcagggaattgtggtgatgcgtaaaggggagaaccccggtgaagtcattgcaaatctgaaagataagatagaagaattgaatcagaatgtacttcctgaagatgtacggataataccgttctacgaccgtgaggacttggtgaacctggcggtaaaaacggtgacccataatctgattgaaggaatattgttggttacgtttattgtgttaatcttcatggcagattggcggacaaccgtgattgttgcggtgattattccattagctttgttattcgcatttatttgtttacgcgtgatggggatgtctgccaatctgctttctatgggggccattgactttggtattattatcgatggggcagtggtgatggtggaaggtgtgtttgtcgctttggacaagaaggcgaaagaggtgggaatgcccgcattcaatgtgatgtccaagatgggactgatccgtcataccgccaaggataaggcaaaagcggtatttttctccaaactgatcatcattactgccttaattcctattttctcttttcagaaagtggaaggaaaaatgttctcacctttggcatatacattgggttttgctttgctgggtgcgcttattttcacattaacgctggttcccgtcatgtcgtccatgttgctgaaaaagaatgtacgcgaaaagaacaaccgctttgtccatttcatcaatcaaaagtgcacggctctttttgataccttctatgctcatcgcaagctgactatcggactggcaaccgtagttgcaggagtcggtttatggcttttctctttcctcgggacggagtttcttcctcagctcaacgaaggttcgatctacatccgtgctacgctgccgcaaagtatatcgctggatgaatccgtaacgctggcaaataagatgagaaagaaactattgactttccccgaagtgaggcaggtactgtctcaaaccggacgtcccaacgacggaacggatgcaaccggattttataatattgagtttcacgtagatatttatccggagaaagactgggaaagcaaactgaccaaactgcagcttatcgacaagatgcaggaagatttatccatttatcccggcattgactttaacttttcgcagccgattacggataatgtggaagaagcggcttccggtgtaaaaggttctattgcggtgaaagtgttcggtaaggatttgtacgaatcggaaaaactggccgtccagattgataagatcttaaataccgtgcagggaattgaagacttgggagtgattcgcaatatcggccagccggaacttcgtattgaactgaacgaacgtcagttggcacgttatggagtggctaaggaagatgttcagtctatcattgaaatggctattggcgggaagtcagcttcgctgttgtatgaggacgaacggaaatttaatatcatggtgaggtatagtgaagagttccgtcagaatgaagaggagataggtaagatactggttccggcgatggacggaacgatggtgcctattaaggaactggcagatatcactacgattacaggaccattattgatcttccgtgacaaccatgctcgtttctgtgctgtcaagttctcggtgagaggacgggatatgggtacggcagttgccgaagcgcagaaaaaggtaaatgcttccgtccatttaccggctggatattctttgaaatggacgggtgattttgagaatcagcagcgtgcttcgaaacgtctggcacaggtagtacctatcagcattgccattatttttattattctgtttattctcttctccaatgcaagagatgcaggactggtattgctgaatgtaccgtttgctgccgtgggaggtatcgcagcccttctgataacgggcttcaatttctctatatcggcgggtatcggttttatcgccttgttcggtatctgcatacagaatggagttattatgatttccgatatcaaggcaaatctgaaactgggttcgcctttacaggaggccactaaagaaggagtccgatcacgtatccgccctgtgataatgacggcggctatggcagctatcggtctgttgcctgcggctatgagtcatggtatcggttcggaatcacagcgtccgttggcgattgtcattatcggcggattgataggagcgactttcttcgccctgttcatcttcccgctgattgtggaagtagtgtatgaacgaatgctatatgataaaaacggaaaattattgcaaagacgtatctaattcattttctattctttctatgaaagaaacggcatagattaaattttaatttcgttttcagtaggtagaagtgaggaagggacaaaagtcggttgaatcagaagatcacccgtacttttgttcctttttctatttccgaagatatttccagtctggcgttgtaggcagatactattttctgcgtcaggctgaggccgatgccctgacctgcatagtcatgtgtgttgctgccccgatagaaagactggaatatatgttctatttcttccggaggaatgccgatgccctgatcttttatttcaagaacgaggtgttgatctttttggctgagcgtaatgtctacttccttttcagaatatttgcaggcattatcgatgatattctttaaagctattttgagcagataaggattggcctttacagtggcagccttacctgtttcttgataatggagacggattcgttcgttcatttttattaagtcattcagcatatccggcagagacattgcctccatattgctttttatgagctcttcatcctgacgtgaaaggaaaagaagatggcggatcagattggagattcgcttgctttcggatgagattcgttgcagggcttcgatatattctccggtacttctttctttcagcagactgatttcacattctccctgtatggcggttatggggttgttcagttcatgcgaagcatggctgacaaaggacttttcagctttgaaagcactgtccagacggtcgagcatgctattcagtgtttcgatcatgtcttccagttcatcgttgtttccggtcgtctttaaccggcggttcagactgttggctcgtatcctcttcagctccttcagtatatgctgcagggggataagaatacggccggaatagattttcccgactaaataaatcaggatggaactgaataaaaccagaaagatggagagaagcaagaggtgttctttgatttctgcaccgtacacattccgggacatgacgaggacgatgaaatttccttcattatcgggataataaagggcggctcccaactggtctttgtatttaaaagaaaaagggacgctgtcttcaccggctatcaggagtgcctgctgatgctgggtcagatatttgttcagtgtgtcacggacttcggagagactgtccatatttaaaagaatctcatgagcttcgggcaagagttcgtcatatttgcgctggataatctggtaactctgttcgtctatttcgtctttctcccagtgcttttgtgcggtcagatatgctttttcacgaagataggaggcatagagtttattgataaactgtgtgctgaaaagatagaatacggcgataatgatgatagttgtcagtacactgagcaacgtatagaagagagctattttagaacctattttcatacacggatttgtttgatggatgttcaggcattcatgatatatcctaatcctactactgtatgaatcagtttcttgtcgaagtcacggtctatctttacccgcagataattgacgtatacgtctacgatgttggtattcgtatcaaagttcttgtcccatacgtctttgagcagcgtaatgcgcgataaggctaccccttggtgagtcatgaaatattcgagcagacggtattcttttacggtgagatcgatatccgcatcacctcttttcgcccgtctggtgttacagtccaataccagattgtcgcaagtcagttgattggttacagtctccttgtttcgtcgcagcagcgccttgatacgtgcttccagttcctgaaaactgaaaggcttgacaagataatcgtctgctcctgcatccagtccttttacaatgtcttccgtagtgcctaaagccgtcagcataatgaccggtgcctggtaaccgaacatctgccgatagagatggcaaagttcgagcccgtttattttcggcatgataatatccaggattacaaggtcgaaaggttcttcctgaaggattctccaacccgtatttccgtcatgacagactgttaccgaatgtccgaactctttcagtccccgttcgataaaggaggcgatattgacttcatcttctgctaatagtatctttgccataaatctacattgtttagatgcaaagatactttttctttgcatccgaagaaagaaaaacggcatacatttaagtgtttctcctttctgaactgtattatatataaacagacgattatactatgaaagtaaaacatttagttggagcttttctgtgtgtgctgggatgctatgcctgtagtagcccgaaaacagaggtccagtcaccggacggacatatcaagatgacattgacggtagacgaaaacggcaaaccgttttataatgtgtcggtggatgactccctcttgatagaaaattcagccatgggctttacggcggctaacggcatcattctggcagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgacactccgtttccgtgtatttgatgatggaatcggtttccgctatgaatacacggtgccgactgtagattctttattgattaccgacgaactgactactttccgtttccatcgtgacggaacttcgtggtcgattcccgccagtgccgaaacatatgaactactctatcaacaacaaccgatttccgaagtggaaacggctaatacacctttcacattcaagactgcggatggagtttacggaagtatacacgaagccgctttgtatgattttccggaaatgactctgaagcaaatcggccattatacattgaaagcggaacttgccccgtggcctgacggcattaaggtgcgtaagggaaatcacttcacgacctcatggcgcaccatacagatcgcaccggaagctgtcggtttgatcaactcttcactcattctgaatctgaatgatccttgcgtactggaaactacggactggattcgtccgctgaaatatgtaggagtgtggtgggggatgcacctcggcgtagagacctggaagatggacgaacgtcacggagctactactgccaatgcaaagaaatacatagattttgccgcggccaatcatatcgaagctgtcctgttcgaaggttggaacgaaggttgggagagttggggcggtatgcagagctttgatttcaccaagccatacgcggatttcgatattgatgaaatcgtacgttatgccaaagagaaaggcgttgaaatcatgggacatcatgagaccggagggaatattcctaactatgaacgtcagatggatcatgccatgcaatggtataccgatcatggtatccacctcctgaagacgggatatgcaggcgcatttccggatggatatctgcatcatagccaatacggtgtcaatcactatcaacgggtagtggaaactgccgcccgtcatcaaatgactctggatgcacacgaaccgatcaaagataccggtatccgtcgtacatggccgaatatgatgacacgcgagggggcaagaggcatggaatggaatgcgtggagtgaaggcaatcctccttctcatcacgtgatgttaccgttcacccgcctgctgtccggtccgatggattatacgccgggaacttttgatattctgttcttgaaaacgaaggattctccgcgccgacagaagtggaacgatcaggataaaggcaatagccgtgtgaatacgacgctggctaaacaactggctaattgggtaatcctgtattctcctttgcagatggcttcggatatgatcgagcattatgaaggacatccggcattccagttcttccgtgattttgatccggattgtgatgaatcgaaagcactggcaggtgaaccgggagagttcattgcagtggtacgtaaagcaaaaggcaattatttcctgggagcagctaccaatgaaagcccccgtactttagaagtaaaactggacttcctggaaccaggcaagcagtataaggctgtcatctatgcggatggcgaaaaggctgactggaaaacgaatcctaccgattataagattacggaacagattgtaacatctgaaaatacgttgagtatacggatggctcccggaggcgggcaggctgtttcgtttataaaaagtaataggtagtaagtaataggtaataggtaataagtaataggtgagggtaataagtgaggttgttaaagtagagagattgtcggaggataacaagataaaattaagttggttaggttagactgaaaaaacggtggacagagttttgatacctgttcaccgtttttgtttttattgagtatggttttgaaaggatgtgttatccttttgcttcctgatacataaagcgtttgattgatttcttcgcagtcttttcaaattcctcgaaatggattttgactttgcttatctgagaataattgggaagctgctgattcagttcaacacgattggcttccataacttttatgatatcggcctgttgcaagccatgggcaaaagcatcgtcaaagtccggataaatcagtgcgaccaacttgtcgtgctgcaaaacgatcagtgactcggcaacataaggcatattattcagtttgctttctatctcttccggatagatattctgtccgctggaagtcagaagcagattcttgctacgaccgcgaactgtcacatatccttcgtcgtcgattgttcctaaatcacccgtgtgaagccatccgttggcatcaataatttgtgccgtcgcttccggatttttataatatcccagcatcatattcattcccctgcatacgatttctccggcatgtgttttagggtcgggcgagtcgatgcggacttccattcgggtggttgccttgccgcaggaagccagtttcagtgtttcccaacggctggagcaaataatcgggccacattcggtcataccgtaagcgatggtgtagggaaagcctatctttttgaggaacgcttctacttcggcattgaaaggagcaccaccgataatgatttcatcgaagttcccaccgaagatttccatagcagcctgccgcgccaacgatttgattttatcgtttacaatgggcactttaagcaatagtttaccgattttgctgtccactctcggaagaatatcttttttgataattttctctacgatcaaaggtacacaggagatcactcttggctttatttctgcaaaagactgcgcaataatcttcggagacggcatacgtgtcaggaagtaaatgtgcgctccggcagagaaaccatataagaaatcgtataccatgccgaatacatgacccatcggaagcatggaaacgatgtgatcgcccgctttcacgggaagcatctcgaaacagtatgccacgttcgaccaaatactgcggtaggggagcatgactcctttggaatatccggtagtgccggaggtataattgatgatagccagttcttccggacggtccttccggtaacagatatgttcggggcggaaattcttcggataacgctgaccgtaaatagcgttccggtgttcgaaggcgtaagtcagtttctcgttgcgcgataccaatgcagtgaaatcggtgagtgaagcgataccttccagtagcggcattgcgtcttcattcagattttcccatgcctgatcgccgacaaagagtaatttggcttcggagtgattgacgatattgtgaatattatccgctttgaactcatgcagaataggaacgatgacggctccgtaagtgatagtggctaagaaggtgactccccaatgggcactgttccggccgcagactgctattttatctcctggctggataccggcactttccaatacaatgtgaaacttggctatcttgcgcgctacatccttatattgaagcgtgattcctttgtagtctgtcaatgcatctttatcccagtttttaatgatgctctgttcaatataatcaatgaactgatgttcttgttccattcgatttttgcacatttgatttaaaattgcgcaaaaataacatttcattaacggaaaccgaagtttacaattaagttttacggttaattaacgggggaggaaagctgactaaaaagtcagtagtacctttaaatggggctgactaaaaagtcggtagtatcttaactctcctccttcgggaaggaggagtccccgtagggggaggtggtaggtgaacacataactctgttgtttacaatagaataggaataaaccttattttacctaccaccccggctttcagccacctctcctttccgaaaggaggggaattggagatactattgactttttagtcagtccctataaacatcaggattcgctgttggcttcctcgtcctctttgggcttttcggagatgagcagcaatttatcgttcacatgcagtttcagcgttccgttcggtatcaggaactcatccccacgtttcacaatcattaccagcgtgcctttggggagattcatatctttcagcgtatctgcctcttccagcatttcctgtgtgatagtcatatctttgaggtctgtatcaatctcttccggaagttccactccgaaatcattccccgtcttttccagcggtttggacagatgtaacaggcgggcaacgaaagaaaccgttgttccctgcactaccagtgaaacgattgtgatgaagaatacgacattaaagataatattcgatccttcgactcctgcaaccaccggataagtggcgaagataatgggaactgctccacgcaatcctacccaggagacgaacagccgcgatttcattgtaatcttccggaacggaagcaaacagaggaacacacttaacgggcgaccgatcacaatcatgaagacaccgatcaatagtgctactgctgcaacttccagcatttcatgaggattaacgagaagtccgaggcagaggaacatgatgatctggaacaaccaggtaagtccgtccatgaacgtataaatgtctttgcggtgcatgatcttgttgtttcctaccataatacctgcgatatatacggcaaggtaaccatttcctttcagtaaatcagtgatagagaaggtgaagaaaacaaacgccagcaacaagataggatacaacgcctgattgtcgatgttgagcttgttcagcatacggatagccagttttccgagcacgtatccggcagccgcgccgactataaactgaatgatgaaagaagcggcgatagccccgactcccatacctgccgattggataaactgtatcaggacaatggtgagcatgtatgccatcgggtcgttacttccactttccagctccagcatggggcggaggttgtgtttcagattcatcttctgcgaacgcaggatggcgaacaccgaagccgagtccgtagaggacatggtagatgccagtagcaatgacgtggtgataggcagatagatattcgtccagctcattccggacagccaccagataaataatccggtgaaaagagcggttagtagaactccgacggtagaaagcacgatacctggacctaaaatgggtttgatttctctgaatttcgtatccatacctcccgaaaacaggatgatgcttaaagcaaccataccgatgaattgcgcatcttttgcgtcatgaaactggagtccgagtccgtcacttccgaacaacattcctactacgaggaacagtaataaggtgggcactccgaagcgatatcctgtttttccgacaacgatgctaacgaaaagtaagatagaaccaattagtagggtgttttctgctgtaaatatcataggcaatatattattaagttattaaatgtgtcgtaataggtctcaccgtgcgaagttacacattatttaaaacaaataaagagtctttttggatgtatttttgtgaaaaaaggtagttaaattgtctaaaaagattaattttgcactcaattaatctacatcatacttatggattcaaacaatcttactcctttacggaaaggagtggtaggagtacaattcttgtttgtagctttcggagctacggtgctcgtgccgcttttagtggggcttgacccttccaccgccttgttcacagccggcattggtacactcatttttcatgcggttacccgagggaaagtgcctatctttttaggaagtagttttgcgtttattgccccgataataaaagcgacagaactttacggattagcgggcactctgtccggaatggtgggcgtcgcattggtttattttgtaatgagcgcgttggtcaaatggcaaggggtgagggtgattgaacgtctgtttcctccggtggttattggcccggttattattctgatcggtttgtcactcgcggggacaggagtaaatatggcgaaggagaactgggtgctggccttgttgtcgctggttacggcagtcgttgtctcgatgaaagcgaaaggacttttgaagttgattcctatcttttgcggtatcattgtcggttatctggcggcatggcttttctatgatctggatttgtccggtgtgagggatgcggcatggatcgggctgccgcagttcgtgtttcccaagttctcatgggagccgatactgtttatgattccggtagctattgctccggtgatagagcatatcggagatgtatacgtagtcaatacagttacaggaaaagacttcgtgaaagatcccggtctgcatcgtacgttgttgggcgatgggctggcttgctgctttgccggattggtcggcggtcctccggtgacaacttattcggaggtgacgggtgcgatgtcattaacgaaaatcaccaatccgcaagtcatccggattgctgccatatccgctatcttattctccgttgtcggtaaaatcagtgcgttgctgaaatccattccgagtgcggtattggggggaattatgcttttgctgttcggaaccatcgcttgtgccggaataggtaatctggtgaataactgtattgatctgagccgtacaagaaacatcatcattgtctctctgacattgactgtcggcattggcggagctgttctcacgtggggagacttttcattatccggcatcggactggccgctttggtcggagtacttcttaatttgatattaccgaaggacgattgactctgttcttgaaatagtcaggactgtgtcaaggttaatagtaactaaactaggaccgacttttaatcagccccagtttagttactattgacactcctcctttttatatttaatagttaaggcttagcatgtatatacgtcttgtgtttatgacaagaacttcataatatcttcgtctgcggtactgatgccaccgattccgaattgttcgatcaatacgttttttacgtttggtgaaaggaaggccggaagagtaggtcccagatgaatattcttcactcccagtgccagcaatgccagcaatacgatcaccgctttctgttcgtaccatgcgatgttatatacgataggaagtttgttgacgtcgtccaatccgaatacttctttcagtttcagtgcgatgacagccagtgagtaactgtcgttacattgccctgcatccaatacgcggggaatgccgttaatgtcacctaaagccagtttgttgtatctgtatttagcacaaccggcagtcaggatgactgtatctttcggaagtttctcggcaaattcggtataatattcacgacttttcatacgtccgtcacatcctgccataacgaagaacttacggatcgctccgcttttcacggcttctactaccttatccgccaaagccactacctgtgcatgggcaaaacctccgatcaacgttccgctttcgatggccgtcggcggttgacattgcttggcatgtgcaatcagtgcggagaaatctttcggttttccgtctttgcgttcggggatgtagtgtgctccctccagtccgcaggctccggtgatgtagatacggtctttgtaagaagcgttggcacgcggaggaacgatgcagttactggtaaacaggatcggtccgttgaaactttcaaactcttctttctgtttccaccaggcatttccgtagtttcctgccagatgcttgtattttttcagttgggggtaataatgtgcggggagcatttcactgtgagtgtaaatgtctatacctgttccttcggtctgttccagcaattcttcgaggtctttcagatcatggccgctgataaggataccgggattattgcggacacctagattcacttccgatatttccggatttccgtagctgtttgtattggcggcatccagttgtgccatggcggaaactccgtgcttgcctgttgccaaagtaagctgaaccaattcttccatcgtaatatcattgcgggtgagctcggccagtgcactttgcataaaggcgaagatttccggcgactggtatccaaggttatgcgcatgctcaacgtaagccgccatacctttcagtccgtagtgtaccagttctttcagcgaacggatatcttcgtcgggtgtgcgaagtactcctactgtcctggctttctcttcaaactcatcttcattcccatcccaaagacattcgtcgggagcatttgcaatggttactttgctggcgagttcgtttttcagttgtagtccttcttttatttttctgatgatggccgctttgtcaaaattggcgttagtgatggtgatgaacagggcatcgtagataaatttgtctgcttcttcagaaggatgtccttcccggcgcagatgttcgttgtacacggcgattcctcgtactacaaagagcagcaggtcttgcaggttagccacttcggatgtttttccgcatactccttttaaggtacagcctgtacccattgcggtctcttgacattgataacagaacatactcataacttttacgttttaattagtcttattgattatgaacgcaaaagtagggggaaagtttgaggtaagtttgtaaccaatgttacattgggcgaaaaaaaatcggatgctatgagctaaattaaattagctataatcatattccgattagctataatgaaaaaaagattagctataatgaaaccggagtgaactcttggtcattgaatcagccggatcagccattctttctgtaagatagtaatctgtttccggtcggctataatcataccgtcttcctgcatgtgcgacagttcacgtgccagagaaggacgggagacaccgaagtaatcgctcagttcctgttgcgagcggtcgagggtgatctgtagctgttgctgctgtttgtataaccgtagcagataagatgctatcttttgccggatagtcttgaaggacataaagaaaagcttatccgatagggtacgggcataattggcggatagattcatataattctccagaaactgctcgttcctacgaaaaagctccagtacgctggctttggggatttcgattacttccgtcggttcgttggcggtcacttctaccggaaagcgattctcttctccgaaaaggaaaagaggggcaagggcccttggtgcggcaatgtcttctactttgatgagtcttccggaatagtcaatcatttcaccacggacacttcctttggtcagtatcacgagacggttgcacacatctccctgtcgtgccagtatttctccttttctataagaacgggtgtggaaactgatctcttccagattggcggataacttctccggagtaatcccccggaataatgggttattggtgagtgcaggtgtcataggctggtctgttatttgaattttaatatgaatttcgtttccttgttgtccggtaacagcgtgaggcttccacccgaaagccgcatgatctgacgcgaaatacttagtccgattccgctgcctccttctttggtagtgaagaaagggataaaaatgtgctccactatttccggtggaatgacgggaccgttattcttaatctcaatcagcacttcttccgtttcgttgcaataaacctgaatgtcgatttgtccgtccggctgatcaccgattgcctgaatcgcatttttcagaagatttatgactacttgcgaaatcagattttcatctgcatgcaggatcaggtcggcaggatcgatctttgtatggaacgtgatgtggtcacaaggattctgatggcgggcaagttccaccattcgttcgatgaatgctttcaagtaaaacaatgaaggttccggagtcggtatccgtgtgaatttgcggtaggattctacgaaagcaagcagcccttttcccgtggcactgatggtttgcagtccgtggctgatctcttcgtctttgtcctccaccatcgagagaagcgtatcgctgagcgaagtgatgggagtcacggagttcatgatctcatgagtcagtactcgggtcaggcgaatccatgaatctatctccttttcgtccagctcaatattaatatcattcagtgcaaggatgcgcagatgttctttgtgtacattgatttctgacacgcgaatagacagattgaccgttccccgttcattgtgaaacaccacttgcagcttatctccggaacaacaactttctatcttctccatcagtgtagcatctactttactcaactggcggacatgggtaaatacattcagtcccaaaagccggagtgcttctttatttttctgatagaccgctccgttatcattgagcaccagcagtcccgtgctgacaaagtcaagaatcagtttgtagtacttttcctgttgggcagtctccgcttttacattatataaaatgtggcccacccgattgagtgcccgattgatctgtttactctcgggagtaccggactcttcggggaaacggaaggcactgtcattattctccaacgcatcgatcatgaagagcacctgcttgatgtgcaggcgataaagccggacttgccagatgatacttaagatcagcagacaggcactgacgctgaaccagacataagactgatgcacgcccaaacagatagtcgccagacagcaaatgaccgtcagtgataccctgaaccaatattggttggctacttgttgtagaatccggttcataatccgaattttttcatcttgttatagagagtctgtcgggtaattcccagttgcgcagctactgccgaaagatttcctgcacaagcatccagcgctttccgtatcatttgtacttccatctcttccaaggtggaaatattcttctcggaagtttctgtctttcgggaggataactggaacaattccgcagggatttgcaccccgtcgttaatgatgaccaccttttcgattgcgtgctccaattcgcggatattgccgtaccagggatgtgcggtaagcttttccttcgctgccggactgaatttcatcagttccttatcatattgcttgcagaagcggatgataaatctttcggcaagagggacaatatcttctttccgttccctcaaaggagggatttctatatgaatggtgttgatacggtagagtaagtcttcccgaaactcttcccggtctaccatttcctgcaaattccggttggtggcgcatatcagacggatgtcaataggaatcggagtgttacttcccactcgcacgatacttcttcgttggatagccgtcaatagtttggcttgcaggtgataggggaggtttcctatttcatccagaaacaatgtgctgtgatcggcagcctcaaactttcctgtccggtcggtatgcgcatcggtaaaagagcctttcacatgcccgaagagttcgctttcaaataaagattcggtgattgctcccatgtccacagcaatcatttcctgttgcctgcggttggaaagagcgtgaatttcacgggcaagcatttcttttcctgttccgttttcaccggtaatcaggatattggcgtctgtggaggctaccttttcgatcagtgttcggagttgttgcatagacttgctttctccccaatagagtgccggagtgttgaccggttcctttttgtttcctgtcttacgtccttgctgtgcggatgaggcggcagcctgtagtgtttctaccagtttctgattattccagggcttgacgataaagtccgaagcaccttctttgattccccggatagcgagatcaatatccgcataagcagtaaaaagtacgacaggaagctcccgtcgtactttctttatttcgtgcagccagaacaatccttcattgccggtattgatgcccgaagtgaaattcatatctaatagtaccacttccggtgtttcctctcgtatcgcagtggtcagtgtgaccggtgacgacagtgtgacgactttcgaaaagtagttttttaaaaggatttgtaccgctgtcagcacccctttattatcgtctacaatgatgatggttcctgatttactcatgtccgaattggtttgtacgctacaaacttacgaaaaagtaattcataattcaaaattcggatttgaatttatagccattggaactttaatccgaatgataaactcagataatcacggggacggaggtagctatttgttacaccactgatcagataaagatcgcatgtacttatctcgtagaagaaagtcacggactttgccagaaatcggcggttagggtcaatatcataggtcagccgttgtcccatgaaaacatggatacgcaccttgcttgaaaaaccatagtatcctttcggataacgttccggttcgctgacccagaactgattgccgaatacggtattcagatatagtccgcaggaaagcggctcggtagagaatcctttccccaggttgatgctccagggcatatagttctgtttcagtgtcatggtcacttttgccttcttggacgaatacttcgggataaatccgagcaacaggtcagtttcccactgatttcgttttccgtaatcccatccggtgccgaaggagagtaatcccatatttccggcatattgtattttagagtgggtcggaatgatgcgttcccagtttttgcggaagcgatgtacacgtctgtcgtagccggtgcgaagaaccggttcggcaatataaggaagtactgtgtctgctttgactattgtgaatgcagaatcaccctcatgaaaggctatgatagaatctgccttaattgccagtttcagcgagtcgggtttatagttcctgataatggtatctggcttgcaagtagccgaaagcaggctggggaagagtagaagcatagtcagtactcctgcgcggatcatatatttagtattcaaccagttcatattcgtatttttccggggttatagtaaataccagataactgcgacttttcatgcagtcgctgacaatataatgcacatcgtcatcaaaaaggattctgtcatcgaatccgtgattatgggcggccgtgcagaactgtagtcccggatattgggtgatgtagtactggaacggcttcgccacattatcattgaacacatctgcaaaaggatgtgcatgcatgctgactacggttttttcaaactcatccgccctgtccgtcagttcctgttccataaaaccgaaattgggaataggctccgaataatcatattccagcgcattggtattaaggcagacgaatttcacattgcccgcaatgaatgagaagttggtaggtccgaaaacagcctgataagtttctgctccggtacccagacagtcatgattcccgataaggacgacataaggcactttcagtccgttcatgatgtcccgctgccaaagaaactctttggtcagcccgaagtcactcatatctcctccgtgaatgacgaaatcgatatcatctctcttattgacctcttttacaaagtcttctgtctcatcataccatcgctgcgaatcgcccatcgtgataaaacggatggttgtctttcctttgcacttagcttctatttgttcaatgttatgagcatttacgtctgtctctccactgatacgtacatcgtaggggtggtagtctatcagatcgcatccggccagaagcaggcagaccaggagagtgtataaattcttgtttaccataaatagaataatttatttaattgaaaacttgatgcgaagatagagttttcagttgagatatgggcgattgcttgggcgaaataagaaaaatggaacaataaataggcattaatgcatactttccactgagaaaagaaatacgattgtctttgtctaataattagacgcatgtgtctaattattagacagtagatgataggacagataactataaatgattgagaatgagtattctcactattgtggcacgttatctgcactgcatcataaaaaaaacaggaatatattatataatcatgagacaaatctattatgtcattcgaactttgctgcgggggcgtagttccaatgttgtcaaggtcatttctttagggcttgggctgacaatgagtattttattatttgcccgcgtggcttttgagcagagctttgataaatgctttaaggattatgaaaacttatatcaagtcttttccatctttacgatgaatggcgaacaactcgaaccgcaggatcaaaattgcggaccggtagcgggtgcaattcttgaaaactttcccaaagaagtggaggcggctaccagttactgcctttgggtgaatgatcctctctatcatggtagtgtccgttttgaagtcagaaagctggcggcagattccctctttttccagacgatgggaatcgaggtcttaagcggaactccggtgaaagatttagcccaaaaagatgtagtttacctgagtgaccgtttggcacgaaagatgttcgacacagagaatccgataggcaaggttatctcatacagtaaggagatagaacttacggtaaaaggcacctatgctgatataccggagaatgcgacggtaaggcctgaagcggtgatttctctgccgtcgatatggagccgcaaatggggaaattactcatggagaggcggcgacagctggctggcgttcatccgttttcgtcccggagccgataagtcggtagtgaatgcccggatagacgcaatgatacagaagtatcgtcctgcggaagatcaaaaagtggttggatataccgcttttgtaaagcccatccgtgatgtataccgtgacaataaagatgtaaggcggatgcggaacatcatgactattctgggtattactattcttttcatcgcttcattgaattatgtgttgatttctgtttcatcactttcctatcgggcgaaagcggtcggtgtgcataaatgcaatggggcaggaaacatgaccatattgagtatgtttctttgggaaacagcgattatcattctgtttgccctgatcctgatgggattgatcttattgaattttcaggatttctttgaagatacggcagctgtcaagttaagcgctttgttcagcttggatcgtatttgggtacctttattaacggtggctgtacttttcgttgtgggtggggtattgccgggacgactgtttgcaaggatacccgttactcaggtattccgccgatacacggaaggtaaaaagggctggaaacgaccgttgctgtttatccagtttgccggtgtagcatttatttgcggactgatgtatgtggtgatgatgcaatattattatatcttgaataaagatttgggttataatccaaagcgtgtagtggtggccaatgccagcttcggtgaggaagaaaaaggaaattatgccttgaatgttttccggaatatgccttatgtggaatccgtgtccagtgccacttatcatcctgtctacggatatagtggaacgattattaatgatgaaagcggacagtcactattttcatcccgttattgcagtgttccggatgattatccgaagatgatggggatggttctgaaagagggacgtatgccccgtggtgacgatgagacagtcgtcaatgagacttttgccgagtggatgcattggggaaacaatatactgaatcgtacggtttataattcgggatacgtatgtaaggtagtgggcgtgatgaaagattatcgcatcggaagttttaccagcccgcaacaaccgttgctgcttatgcacaccaagaggtttggtgattgtatccatgtccggttgaaagaaccttttgccgagaatcttctcaaactgaataaggagatggagagtgcatttcctgataagactatcgaatttcggtcgatgcaacagatgatcaaagagaattataactctgttcgtgttttcagtaatgctacgatgctggcggcaataacaatgttttttgtgatgttgatgggattgataggctacactacggatgaggtccgccgtcgttccaaggagatagccatacgcaaggtgaatggttctgaagcaaccggaatcttggaactgctggtgaaagatgtgctttatgtagctgttgttgcagttttaatcggagtggtagcagcatggtacgtcaatggtatgtggatggatttgtttgccgaacatgttccgctcagttgggctgcctatcttctgatagcaattgcaaatctggcagtcattgtggcatgtgtactttggaaatcatggaagattgccaatgaaaacccggtcaatagtataaagagcgaataaagaagaaataaaaagtataacaacataataaatgaacaagatgatacagattgaaaacattagtaaagtattccgtactaccgaagtagagacagtcgcattaaatcacgtgaaccttgaagtaaaggaaggagagtttgttgccattatgggaccttcgggctgtggcaagtccaccttactgaatattcttggtttattggataacccaaccgaaggttcttaccgattattgggagaagaagttgccggactgaaagaaaaggaacgtaccggcgtccgcaaaggcaaactgggctttgtatttcagagttttaacctgatagacgaactgaatgtctttgagaatgtagaacttccgctgacctatcttggtatcaaatcttccgaacgccgccgcatggtagaagacatcttgaaaaggatgaatatcagccaccgtgccaaacacttcccgcaacaactttccggcggtcagcaacaacgtgtggcaattgcccgtgcggtagtgactaatccaaagcttatccttgccgatgagcctaccggtaatctggactccaagaatggcgcggaagtaatgaacctgctgacagaactgaacaaggagggaaccaccattatcatggtaacgcactcacagcacgatgcgagtttcgcacatcgtaccgtacatctgtttgacggtagtgtagtggcaagtgtaacggcataaaccggaacgacaatgagacaaatctattatagcatccgaaccttactgcgcgaacgcggcacaaatatcatcagggtaatttctctttcgctgggacttactattggtattttgctcttttcgcagattgcgtttgaattgagttatgaacgttgctatccggaaccggaacgactggctattgcacgttgcctgaccactaaccttagcacgggggagacaatgggagacgacggcaacaattatgattacacactttttgatgtggttgcatctactttggcgcaggatatgcccgaagaaatagagtttgccagttgtgtcctcaccggacaagggatgagtatatattacgaagacaaattattatcggacgttaactatatatacgctgatacttgtttcttccagacttttggtatccctgtcttaaaagggaacccgaaagatatgatcatgccgggaagtgtgtttgtgtcagagcattttgcccgtgaaacgtttggagatgcggaccctatcggtaaaattcttaaagcagacaggcaaaatgattttactattcgtggtgtatacaaggatatgccggagaatacggtgctcactcacgactttgttgtctccatccatcgggatggaggatatcagggaggatatggctggaagggaaatgatgtcttttacacgtttcttcgcctgcgtaatgctgcggatattgacaaggtgaatgacaacatccaacgggtaatcgaaaaatacactcctgcccagtatgatgactggaaaatgaatttcagtgtcatcccattggtgaagtatcatttgatatcttccgatgtgcagaagcgtttgatcatatatggctttctgggattcgctatcttctttgtggccatcatgaattatatgctgatatctattgccaccctaagccgtcgtgccaaaggagtaggagtacataaatgcagtggtgccagttccggaaatatcttcggcatgtttttggcagaaacaggaatccttgttatcttttccgtacttcttagtcttctgctgatagtcaacgcacatgaaataatcgaagatttgctttctgtccgtctatcctcactttttgcgtgggagacactatgggtgcctttgcttacgattgtgatacttttccttttggcaggtggcataccgggacggctgttttcgcgtataccagtcacgcaggtgttccgtcgttactctgatggtaaaacgggttggaaacgttcgttattgtttatacagttcacaggtgtctcatttgttttggggctgttgctggtaacgctcctgcaatacaaccatctgatgagccgcgatatgggaataaacgttccgggactggttcaggcaggaacctggttgccgaaagaaacggtagagcatgtcaccgatgaactgcgtcgccagcctatggtagagggagtggctgttgctacaagcggagtaatcggacagtactggacacgcggactgatgagtaatgacggtaaaagaatcgctacacttaactttaattattgcagttataactatcccgaagtaatgggaataaagattatcgaaggcagcactcttaagaaacaggacgatttattggtgaatgaagagttggtacgtctgatgaaatggacagatggggcggtaggaaagaaactgaatgatatacagggtacgattgtcggtgtcttccgggatgtccgcaactatagcttcttttcaactcaggcacctattgtcttgataggatcggagaataccaatcatgtatttgatgtccgtttgaaagagccgtatgatgaaaatctgaaacgtctgaacgagtttgccgataagacatttccgaatgtagccttgcatttcagttctgtagacggtatgataaaggatatatacaagagtgtatatcgtttccgtaattcagtctggatcacttcaagctttattctgctgattgtaataatgggattgatcggatatgtgaatgatgaaacgcaacgtcgaagcaaagaaatagctatccggaaagtgaatggagccgaagcttctcatattttgcgtctgttgatacgcgagattctgtatgtctccgcatcctccatattgattggtaccattgtttcctattttgtcggaaaggcatggcttgaccagtttgccgaacagatttatatgaacccgttattgtttgtgggtacggcgctgtttgtcttattgctgatcgtagtttgcgttgtgttgaaagcgtggcacatcgccaatgagaatccggtgaaaagtataaagagcgaataagaatattattatcttttaggcacggattaacgcggcttttatgagatgcattcattgcagaagtaatcttaatccgtgtattcgtgcctaaatatttttcatactgatatatcttttagcatagcgtcctttttgctttattccgccactttatccgctatcggatgttctttcgatactttctttatataaatcatcagactgataactgccgtaataaatgctaaagagtccgataccggcagactgatccatattcccttcagtccccaccaatgcgggaataacaacaggcaaggcagcaaataaagcaactgccgcgtcaacgaaaggaaaatacttatttttactttgcctatactttggaagaagttaccgattacaatctgtgctcctacaaacgggaacataagtacagtcaaccgaagaccgtccaccgcaagtccgattaactcatcactatccgtgaagactgccgatactgcatgagggaaaaactcgcaaatcagaaagccactgcttgtaatcactacaccggaaataattcccagctttagcgtctgtttcacccggtctatcttctgtgctccgaagttgtagcctacaatcggctgcatgcccatcgtcagtcccaatacgatcatgacataaagcgtcagcaaccggttgatgattccgtaagcaccgatagccatgtcgcctccatgttcctgcaaactattattaatcacgataacgatggcacaagcacagacattcatcaggaaaggagacatgccgatagcgaaaatactctctacaatccttcctttcattttccagacctttccctcaaaatgcaccgtactgtctttcttgcagaagtggctcaccacccataccattccgatcagctgtgagataaccgttgctgtagccgctccccgcattccccattcaaagtgaaagataaagataggagcgaggatgatatttgctactaccgttaccatagaagtaagcatcgctttcttcggatatccggtggcacgcatcacattattcagaccgatcatcgtgtatgtgatgggagttcccaataaaatcacctgcataaaactccgtgcataaggcagtgtgtcgggactggcaccaaagaaagtcagtatatcatcaagaaagataaaagacaggataccgaaaaagaaagaatttgtgatacagagcatcagcgtatgtgacagaatctccgtagcccctttcatatctttctgtcccaggcgaatagaagcgatggtagaaccacccgccgaaacgagtgtacagaaagcaacgaccagattcatcagaggaaagctcaccgccagtccggcaatagccatcgcacccacaccgtgaccgatgaagatgctgtcgatgatattatagatagacgtgattgtcatcccgatgatagcgggaatggagtattgcaacagtagtttaccgatgctttcttttcctaatatgtgcggatcgtttttgctcatgcgctcgtatggattgttggatgaaaacgaatgttacgtttttttaagtggggcaaaggtacgaattatttgcctgattcgatgattattcggaactttgcacaattcaatacacaaggtttaacgttttaggtaaaaagaaagattacgtatggatacaacaaagacaattgcggcactgttcgattttgatggtgtcatcatggatacggaaacacagtacactgttttctgggatgaacaagggcgtaaatatctgaatgaagaagacttcggccgtcgtatcaagggacagacgctgacccagatttacgagaaatatttctcggacctccccgaagctcaacaagagattacggccggactcaatatttatgagaaaagcatgtcctatgagtacatccccggtgtagaagcttttattgccgatcttcgtaaacacggagcaaaaatagccgttgtaaccagctccaacgaagagaagatgcaaaacgtctataacgcccatcccgaatttaaaggaatggtagaccgcatcctgaccggagaaatgtttgcccgttccaaacccgctcccgactgtttcctgctcggtatggaaatattcggtgctactcccgaaaactcgtacgtgttcgaagactccttccacggtctgcaagccggaatgacttccggtgccaccgttatcggtcttgccactaccaatacaagagaggccatcaccggaaaggcacattatataatagatgacttttcggaaatgacctttgaacacttattggctttgcatcgttagttttttcttgttatcttcttgatttgtccttttggccgccttctcattaacttggggaggtgtttgaaaggattttttctttttctttctcacttatgaaagaaatgttataactttgccgcaatttttgatggcgttgacgccttatttaatttctagttttaatttaaaatttaagaaacatggctggttatatatcagatgacacaagaaaggtgactactcatcgcctggttgaaatgaagcaaagaggcgaaagaatatctatgcttacttcttatgattacacaatggcacagatcgtagatggtgcgggaatggacgtaattttggtaggcgactccgcttccaacgtgatggcaggtaacgtgactacattgcctataactctcgaccagatgatttatcacgctaaatcagtggtacgtggcgtaaaacgcgctatggttgtagtcgatatgcctttcggatcttatcagggtaacgaaatggaaggtcttgcttctgccatccgcattatgaaggaaagccatgccgatgctttgaaactggaaggtggagaagaaatcatcgatacggtgaaacgtatcatcagcgcgggtattccggtgatgggacacttgggactgatgcctcagtccattaataaatacggtacttatacggtacgtgccaaagatgacagcgaagctgaaaagctgattcgtgatgctcatcttctcgaagaggcaggctgctttgccatcgtactcgaaaagataccggctactcttgcagaacgtgtggcttccgaactgacgatacctattataggtattggtgccggtggtcatgttgacggacaagtattggtcattcaggatatgcttggaatgaacaacggattccgtccgcgcttcttacgtcgttatgcagacctgtatacggtgatgactgacgctatcagccgttacgtatccgacgtgaagaattgcgacttccctaacgagaaggaacaatattaaaacagtatatggcagttaaattgtggacagttcattttatgcggatatgcgtagctaatttgctgttgtttatctccctgtatatcttgtttccggtactttccgttgagatggcagaccgtctcggagtaccggtggcacagacaggagtgatctttctttttttcactttaggaatgttccttatcggtccgttccatgcttatctcgtagatgcttataagcgtaagtacgtatgtatgttctcttttgccacgatggtggcagcaacggcaggatacgcctttgtgacgaacatcacggaacttatcttgttgagcaccgtacagggactggctttcggaatcgctaccaccgcaggaatcacacttgccattgacataacgaacgctacacttcgcagtgccggaaatgtcagtttctcctggatggcacgtctggggatgattataggcattgttctgggtgtctggctttatcagagctattcctttaaaaatctattgtctgtatcggtgattaccggagcagcaggtgttttgatggtatccggagtatatgtgcctttccgtgcaccgattgtgaccaggctttattcattcgatcgctttttgctgttgcgtggatgggtgcctgccatcaatatgattctgatcaccttcgttccgggattgttgattccgcttgtacaccgtttccttaacgattccgtattgggaagcagtggaatccctataccgttctttgtcggtacaggcatcggatatcttgcctccctgttgctggcgcgtctgtttattctgaaagaaaaaactctgcggctggtgctcgtcggcatcatactggagattgtagccatcactctgctggcctccggtttcccggtaggcgtaccttccatactcttgggtttgggactggggttggtgatgccggaatttctggtcatgttcgtgaaactgtcacatcattgtcagcggggtacggcaaataccactcatctgttggccagcgaagtcggattcgcatccggaatagctgttgcgtgttacttcgatttggaagcggataagatgctctatacaggacaggtggtagctgtgattgctttgattttctttatactggttacatatccatattataagagaaagaaagtgagataaatcgtttcgcactatttccgtgacatgattgtctatcataaataaaaagactggcgttatcctgacggagataatgccagtctttttattaaagacctgtcaacagatttgttgttagcatagagtgcttagtttctgcttacctgtttaactcccttcactgtccgcagctttttgatcagcgcttccagtcgtccggtatcacccaccatgaccgtaagcgttccggagaatagtccgtcgttagaattgattccgatggaccgcagactgattccattctctttggaaatgatggaagtaatattggtaacaatgccgatatcatcatgacctactacgcgcagcgtaataggatactgcgtaccgactgacttgccagcccaacgcgctttaacaatccggtatccgaaccgttcgcgcatctgattggcattcggacagtctgcccggtgaatcttgatacctccgctcacggttacaaatccgaatacatcatccccatagatcgggttacagcatttggccagtttaaattccagtcctttcagattctgatcaatgaccagtacatcctcttttgaactaggttcttcctgagttgcctgcaaattatatccttcggcactgcgatacacaatctcatcgtgcgtgtcattgtcccgtctctgctgttcaaggtatttgtccagaatgtcgttgacatccaatgtctcgtcagcaatcttctgataaaactctgtcacatttttaaagcccagccgcttgatcaggcgcatcatggtggcttcgtcatactccatcttccggttcttgaacttccgttccagtgtctctttggcgaaatcgtgctggcgtgctaccatctctttgagtgcctgccgtatcttggtgcgggctttggaagtcgtcacgatgttgagccagtcctgtttgggagtctgggtattcgacgtcatgatttctacctgatcaccgctgttcagtttctgtttgagctgtacatttttgccgtttactttcgcaccgatacacttgcatcccagtttgctatggatgtggaatgcgaaatcgagcacagtagctcctttggcaagtttgaataagtctcctttaggcgtgaatacaaatacctcatcctcgtaaaggtccatcttgaactgatccatcactttcagtgagtcgttatccgcattttcaagcgcttcacgtaccgaagtcagccattcgtccagtcctgtttcccctttgatacctttgtatctccagtgtgcggcgagtccccgttcagcgatctcgtccatccggcgggtacggatctgtacttccacccatcttccttccgggcccatcacggtaatgtgcaacgattcataaccgttgctctttggaatcgagagccagtcccgcagacgtttcgggttcggctgatacatatccgttacgatagaatagacctgccagcattcctgcttttctttggccgggtccggttcggaatccagaatgatacggatagcgaacaagtcatagataccttcaaacggagtcttctgcttctgaatcttattccagatggaatggatggatttggtacgtcccttgatgtcgaacttcagtccggcttcctttaccttcttctggataggatcgatgaaagaagcgatatacttgtcgcgggatgctttcgtctcgttgagcttctcctttataaagtagtaggtttcccgctgcgtatatttcagcgacaagtcttccaattccgatttcagcttgtaaagtcccagtttgtgggccagcggagcatataggtaagcagcttcgttcgctactttcacccggtcttcctcgttgcctgtatccttgatttggcgcatgatgttcacacggtctgcgatcataatcaggatgacgcgcatatcttcggcaaaagagagcaggagattgcggaaattctccgattctatcgccggacttttggagtacagttcgtttgttttcaccagtcctttgatgatactgcctacatcttcgccatattcggcattcacttcttcgatagacaggatatgtgccttcactatttcgtgaagcatgatgccgaccagacacgaacctttcatgccaatttcttcggctacgataactgccgtttgtaaatctctgatgacgggattcatcccgaagttattgcgttgcagcccgttacactgggcggctttgataagatgtttctttaatttttggcaatccctccagaaaatcgtatctccggcagattgcaacagatgcctgtagagtgaaaaaagctccttcttttcctctgatgtaaaaaagtcgtccatattcaatcttgttaattcgacgtaaaattagtttttttcccggttattcggcaagaagtaaataacattttgtatttttgggcatcaattaataaaaatagatattatgataacgacacaggacaaagagttgcttgccaagaaaggcatcacggaggcgcagatagcagaacagctggcttgcttccagacgggttttccttatttgaaactggacgctgccgcttccatagaaaaaggcatattggctcctgacgcagaagaaaagaacgcatatctggctgcatgggatgcttataagaatacggataaaatcatcgtgaagtttgttcctgcttcgggcgctgccagtcgtatgttcaagaatctgttcgagtttctgtccgcagagtatgacaaacctactacaaagtttgagcaggcattcttcgacggaatcaaggattttgctttctatgacgacttgaatgtagcttgtcagcgtacagccggaaaagatattccggggctgatggaagaaggtaattacaaagccgtagtagctgcccttctcgaaactgccggactcaactacggagcacttccgaaaggtctgctcaaattccataaatatcccgaaggttcacgtactccactggaagaacatcttgccgaaggcgctatgtatgcagccggaaaaagtggtaaagtcaacgtacacttcactgtctctaccgaacatcgcgaactcttcaagaaactggtggaagagaaagccgaagcattcggcaaacgttacggagtagactattacatcaccttctccgaacagaaaccaaataccgacaccatcgctgccgatatggacaaccagccgttccgagacaatggtaaactcctgttccgtccgggtgggcacggtgcactgatcgagaacctgaacgatctcgacgctgatattatcttcatcaagaatatcgacaacgtagtacccgataaactgaaagccgacaccgttacttataaaaaactgattgccggcgtactcgtgtccttgcagaaaaaggcattcgaatacctcgaactgctcgacagcggaaagtatacgcacgagcaaatcatggaaattctccaattcctgcaaaaacaacttttctgcaagaatcccgaaacgaagaacctcgaagatgccgaactggtgatctacctgaagaacaaactgaaccgtccgatgcgtgtatgcggtatggtgaagaatgtaggtgagccgggtggcggtccgttccttgcttataacagtgacggaactatctcactgcaaatcctcgaaagctctcagatcgacatgaacgatcctgccaaaaaggaaatgttcgaaaagggtacgcacttcaatccggtagacttggtttgtgccgtacgcgattataaaggtcacaagttcgacctggtgaaatatgtagataaggcgaccggcttcatttcttataaatcaaagaacggaaaagacctgaaagcgcttgaacttcccggcttatggaatggtgcgatgagcgactggaacacagtattcgtagaagttcctcttaccactttcaatccggtgaaaacggtgaacgacctgttgcgcgagcagcatcagtaggatttaaaacaagattgggtccagtctgtcattcttcctcctccgcggtcgtccgaatggcagatacagacaaatgtctctcccgatcattataattactaattaagtaaaagcaaaatctgagaggctgactaaaaagtcagtactatcttaaatctcctccttcccgaaggaggagatttaagatactgccgacttttagtcagccctagtgtagatacaaccgactttttagtcactacttataataaaaagagtatttaggatgaatcagatagaaaagatcattgacattgcaacatggaacagaaaagagcattttgaacatttcagcgcattcgatgatccctttttcggagtgacagtccatgtagactgtacccgttcttatcaggaggctaaagacaaaggcgtctccttttctcttttactattacatcgtatcatcactgccgcaagcaaagtcgaggaattccgttaccgcatcgagggcgacaaggtagtctgctatgacagtcttcttcccgaagcgacagtagggcgtgccgatcatactttttcttttgctgcctttgagtacgatcccgatgagctcacttttatccgtaaggcgaaaaccgaaatggagcggctgcaagccaccaccggactgaacaaaggaggaactttccatcccaacgccattcactattcggctgtcccatggctggcctttacagatatgaaacacccttcgaacatgcgttcgggcgatagcgtccccaaaatatccaccggaaaatactttcgggaaggagagaagctgatgctccccatttccgtcacttgtcatcacggactgatggatggttatcatgttgccaagtttattgagacccttgatttatgaaaccgtcaggatctggagactaacaatgacggcactatgagaaacaagaccctgagatggaaaaccatcgctctttgttccatcatgttttgcctgccgaagactcctttggcagggcaggagtcttttggttttatccatcgtttgggaatggaagcccgtccgcaatatgtatttcctaccaaccccttcctgcaaggagagaacgaacgctggaaaccgattcagacatcgtttgccgcccacttgaaatactcgttcaagtttcgccccaatacttgtgccgaccgtatttacggtggagcttatcagggtatcggtgtgtcccttaccacctttggtgataaaaaacagttgggcgatcctttctcattctatgtgtttcaaggagcacgaattgcccgtttctctccccgtgcctcgctcaattatgagtggaatttcggtttgtccgccggatggaagccatacgacaattattataattcctataatggtgcggtcggttcacggatgaatgcttatatcaatgccggagtttacataaactgggcgttttcccgttacttcgatctgattgtcggaggcgatttcacgcacttctccaatggtaacactaaattcccgaatgcgggaatcaatactgccggagccaagatcggactcgtctacaatttcaatcgtacggaagaagacctctcgaaatcactctatcagcctgtcaccacccgttttccccggcatatcagttatgatgtcgtgctgttcgggtcatggcgtcgaaagggagtgtgggtaggagagaagcagatcgcatctcccaatgcgtatcccgttgccggattcaattttgccccgatgtataatctgggttataaatttcgcgtgggagcttcactggacggtgtctatgatggcagtgccaatgtatatagggaagatgtaattgtggaatatgggagcagcagttctaaacgtgagttcctgaaaccgggcattcagcatcaactggccttgggactttcgggacgtgcggaatatgtgatgccttattttaccattggcgtcggtatgggagccaacgtgctcagccgtggcgatatgagaggcttttaccagattcttgcattgaaaatagccgttacccgcagttcctttcttcacatcggatacaatttgcagaacttccagacgcccaactatctgatgctcggactcggtttccgtttccacaataaatatcctaaggtacgtcattaataaaaagaaatatactaattttgcatcactaacataaaacactcaaaataatgaagaaaatattgttactcggttccggagagttaggaaaagagtttgtgatctctgcacagcgcaaggggcaacacgtcattgcttgtgattcttatgccggagcacctgctatgcaagttgccgatgaatttgaagtcttcgacatgctggacggtgaagcattggaacgcgttgtcgaaaaacatcatccggacatcatcgttccggagatagaagccatccgcacagagcgtctctatgactttgaaaaagaaggaatccaggtagtgcccagtgcccgtgccgtcaacttcacgatgaaccgtaaggcgatccgtgaccttgccgccaaagaactcggcttgaaaacagccaactatttttatgccaagaccctggacgaactgaaggaagcagccgccaaaatcggtttcccttgtgtcgtcaaaccgttgatgtcttcttccggcaaaggacagtctctcgtcaagagtgccgacgagcttgaacatgcctgggaatacggatgcagtggcagccgtggcgatatccgcgaactgatcatcgaagaattcatcaaattcgacagtgaaatcaccctgctcaccgttacacagaaaaacggacctacgctgttctgtcctcctatcggacacgtacagaaaggcggtgactaccgtgagagtttccagcctgcacacatcgaccctgcacacttgaaagaagccgaagaaatggcggaaaaagtaacccgtgccttgactggtgccggactttggggagtggaattcttcctgagccatgaaaacggagtctacttctccgagctttctccccgtccgcacgatacgggcatggtgacattggcaggaacacagaatctgaatgagtttgaacttcacctgcgggccgtactcggtctgcccatccccggcatcaagcaggagcggatcggtgcaagtgccgttatcctttctccgatagcgagtcaggaacgtcctcagtatcgtggcatggaagaagtgacgaaagaagaagacacttatctgcgcatcttcggcaagccgtttacccgcgtcaaccgtcgcatgggagtcgtactttgctatgcaccgctgaactccgatctggatgcgttgcgtgataaagcgaaacgaatcgccgagaaagtagaggtgtactaaataaaaaagaatgagagtgagtcaaaagcaaaaggatagtgaatattgcttttgattctctctcatcatctcctcttatataactcataatgaaaaacatgaaaaagactaaactattggcagctactgctatgctattactgacttcctgttcacctaaagtggtcactcatattgtaagaacctatccgaatcccgttccggcagattcggtttatgtcatcgaaccgggagatacagttccaaacacagccgaaacgctcggaagtgtttctgttgtagaccggggtacatccagaaattgtcgttatgatcaagtgctgcgcctggcacaagaagccaccgggaagaacggtggaaacggactcgccattaccgaacatgtgaaaccttctttctggggaagttcctgccatcaaatcaacgctttaatgcttcgcctgacggacacaaaggtgaatgcgactgaaggaaaccctgtacaagacatgattgaccttggccgggtggctgtgaaagaagaaaaggaagagcggagagcacctgccaacacgttcgaagcgagcttcgggtatggttgggtgaccagcaaaatgtatgatatcaacggtgcgactttagactccaaaggaggaatcgattggaagctcgcttacgaatatacgtggagcaatggtatgggaatcggattgcaatattccggtttcagaaagtctttctccgatggaggagacatgaccttctcttatatagctcccgagtgggtaggtcgctcgaagttcgacagatggattttaaagtcgggactcgggatgggcgttttcctttatcatgatcccctctacagtgctaccggatttggttttcatgccacggtgggagtggaatatatgctttccgccaattggggactcggcttgactctgaacggaattagcggtagcctgcccaaacaagactggatgctgctgaaagaagacgagcgttgtggaatcacccgctttaacctgttgggtgggttgcgctattacttctgatgataactccttctttctaggaagaatatcaatgtttatactgtacttagatttataaataaagagagagggcagaagtctgaaactgcatcctctctctcgcgtttataacattgttatttctttgatcttacagactcatcgcattaccgcctacaatacccagcactgccgaagccaccgcgatgactactttcaaaatggtatcccaaagggatctcttgactgccataactttacacacctcctttccgactctttacatgattgattactaagtgaatcattaccgaatgaatgattgcaaggcataactttcctcctttacctcaaagcacgggcacgccttgatccactcctccggctcaatctctccattaccgttgcgatccggcgacaagtcgcgatgaccgcacacccggcaaccggggaatctctcttgcaactgatgcaccagcagccggagcgctgcccgctgttccggtgtccgtgtgtccgccgggcgtccccggcagtccaggccgccttcgtagcaaattccgatactctccgcattaaaacctttcgcatgtgccccgatccgttccaccggacgggtaagatgcgttgttccatctttgcggatatagtaatgataacctgtcccgttaaatccccgccggcggtgcatcgtatccagatcaaaagccgtcaactccttgtctgcccgcgttgcagaacagtgaatcacaattaaatgaatcttcctcataaagccactaattctaactatcaatccctcgtacattgattaccaactctcaactctccacttcttacactgtcgggtccggagcttcctcgtcgcctccgccgccttcgtttccaccgccaccgggggtgttgtcctctcctgatccgtcgcctttcttctttttcggggcttcgaggtcgagaaactcgatcttgtcaccggcacgggtagacgttaggttggggcggacgctgctggaagggcggaagttgatctgtatagatttgatattcttcaccgtacactcttctttcgtggttgctcccagcgtatgggcggataggctgaatacaccgaagtctctgatattgaccgattttccgtcgaagagcgccgctcgcattgcctccacatagttggtcagtacgctttggatgtcgcccagggagagggaactcttgtctttcatgatgtaggcgatgccgtcaaggtctacactttggcccatcgtcaccagttgggggtggtacttcagcaccccgtcaatttttcgcgggtctttacgacccattcttttaaatggtattgccatgatgataaattaaagatttagaaaaatataaattaataattactgattgctgtcactcgatcagtgtcgggagagagaatgagctctgtttctttctttcgatgtgtcaaaggtagcctattattaagccatgagaatacgtactttatcgtacttcgtcgtactttctttcagaatgtatttactttctttctgattgattttattttacttgtttgcttgtgtgcgcaaatatgttttagtatatttgaagtacgaaagaacttaaaaacaacgatatgaaaacagaaaaagaagaagcggaagaagaaccgtttgtcatccgtccgtatttgaagtcggagctggctcacaagtacaatccacatttgccattgatttatgccatgcagaaactacggggatggatcagaaataataaagaactttatgacgctatgtatagcggtggagaaggaaaaaacgatcatgcttatagcagcagacaggtgaggctgatcgtgaagtttctcgatgagccgtgaatctgtttttcgatgagtcgtgaatctgtttcttgataagtcgtccgtctgtaaggaagaaacaaattagctattagcatatcgaaattagctattagctaatttgtttttgctaatagctaatttcgatatgctaataagacttattgtttttttcttgtgacaatgaagtaaaagtcacgaatttcccctttcaaagtccagtaaagtccagaaagtccatattagattttcagaatatacgaaccgtgacctaacttgctgattctccctgctttaatgcctttattcaataagtagtaaacggtgcttcttgagaggttcaattcctctcccaaagcacatgcttctttggctgaaaaactctttttgagtttcgtcagaagtcgcgagagattatcgggcgattgtaatggtttcgtatcttcggcagagctttttaccgaagtactgaccagtttactatgttcgaagcaacacagcacgatggcgagcgctgctttgaaatgcgcgtccgagcagtatacttcgggtgtttccattctcatggttcccttgtcgatggcggagaaaatgcagcagatgcgtgccgttatcactccataacgtttcaccacccccagcaggtcatcattacctaactggtccgtatctttgagcagttgcgtgaatacccggttgaattcttttttctgtgtatctgtcagctttacttccgtaggagaatctttcagaaacaatgccatctgtgcgaagcgcatggacaactcgttgaagagatcgtccgcccgcaccttttcctccgcgaacacatcctgccatgctgccggaagtctgaaggtattgatcagaaagcggttgtacagccctgtctccatggtcgggatgaataaaatgaggctggatggagtgccggtgagaaaagccgacagggagggatattccactttcagcggatgtcgtccgttgatcttgtaggacgaactgatcagttcgtgctcgaatgccttgcagaggatatcgtcgaagtgtccgtaatcttggttgcgggctgtgctgacgctgctggcttcggtactggtgagcaaggaagaacaactttggttgttgatgaggtgagtgatgagctgtgcacggctgatgtcggcagggatcagcggaaatgccagcttcggctcctccggttcgtccggcaggttggtggcagcagtattctttttgcgtatcgcctgcaaggagagggtgtagtccctgagtgctttcttgtattccttttcgatcttcagactctgcttctcccaatactcacaatagtgcttgtgcaggcgtatgccatagccgatgaggttcttgttggcaccggaggaagctacgacgatacagtagatattgggctgataattccgtcggttgtagcggatgcttacactggggagcatgctgcttatcgtggtaatacatgacaacaagagtccgtccctttcacgctcatctcttgcgatggagacgcactccttgaagatggcgggaatgagatcgtaaatttcgtcaggaaaggtcggagtctgctctctgagctcttctccgatgatttcatcctccttttctgccggattttcgttttctgaaaatcctataacggacttttggactttactggaatttgaaggaggattttcgaagctttccgtctctgccgcagtcattacattctggtaagctgattttacagtacgtgcgatttcgggctcacggaagttgtcttcttccaaggtgcgaaccaattcggtggtcagttcgttacggtcgatgccgcgtttgcaggcagcgcagctgagccggaaaacggttccgttccggtcgcccgttgcggcagggtagagggtgaggtaggactgtacgaagggagcggcggaaatccggttatccggcatcgcaggcggatgtccgttggagaaagaggtgggagtgcaggtggtacggggagcggaagtgacgggagcgtaggtgacgcgcagagtgagtgcaccgttcggcagaaagtcgttgacggcctttgcgtcaccgttgtagtatgcgtccgggtcgtatgatccgaagcagggatgggtgatatccttgcatttcccgtcgttctctacgccgagaacggtggaaacgagctttgccgtcgcttcataaatggcaggataatcgtttactccatcgatatctatacgaatgaacaacttaacaccacgtccggagatgctgataaacgctcccagtacgtattcgagcaggcaggcacgtacgaaaatatcctttgtctgttcgtccgtatggtcgatgtcgatgcagagtgcgagtgacagggaggtaaggttgttttttgcgtgtccattcttgcatatgcctgcggggatgacacatgccatgctgtctttgatggtttgcgcgtcgtgtttgcggtcttttgccagacagctgcggtggccttccgtaggcactttccaatgtccgttgcgtaccattgcgaaaaaatcttcaaaagttatagtcgtgggagttttactccaagtgttgataaatagtgacacttggtacatgtgctttctcatttgaaatataatatataagttgccggaagcgggtggtgtagttatcacgggcttccggctgcgaaggtaggaacttctctttttttaccaaatcgattattaggactgatttctgttccaatcgtcccattggtctttcaccatctcctccagttttcccagacagcttttataggctatggcatgcttcggagagcgttcgtcgcggatttcgatgcaatggaacagccctttcagtacatccggacagcgtggcatcagcggtatctgcttgatgatccgttcttctttgttgcactctttgatgtctttatcctgtacggatttccaaagaaactgttgcttgaaaatctcttttgcaaggatttcaagtaattcattttgagtaaataagatggggaatccgggtaggtgacattgagatatatcatctactgtcaacggattgcctgctttgtctaccattgttacgtttaacgtaaagttgccgattttttcggcaaaagccaaaaggttttttttaccataatttttaggattaataatgcagcaaatttcttctttttttatcagaagagtgttttttgcttcttattttttctgctgacatttaacaaagtggcaaaattaaggaatttataattttcttgccgaaaacttttccgcttcaggcaaatggggagtgtttaataggatgtacgtgcccggatataaaactagttgcatatgctactattttatcgctcgtttaagtgtttgaatattaccgttgaatgggaaaacttgatgttaagtcatagttttaatgatattttataattaacaggcttgttttactatacaatcgtaattggaatgttccgatattggtctgtttgtagtctttgttggcctaacaagtgttattgaacgacaaataatgaaaaaggaagaacaacgatgctaatttgtttctacatttgcgcggttgtttatttaactattttgttaaaaagaaatcgggcatgattgaacaaaagctaaatttaactgtttactatagtagattaaagtagataaaacgcgaaacgttccttgtcatgctactaaaattcgataggtaaagaaagaataatataaataaagattgcttatgtcacagattatcggacatatctcacaggtgatcggccctgtggtcgacgtgtactttgaaggtacggacgcagagttaatgctgccaagcattcacgacgcactggagataaagaggccaaacggcaaaatactggttgtagaagttcagcaacacatcggcgagaatacggttcgtaccgtggctatggacagcactgacggacttcagcgaggcatgaaggtgtatcccaccggaggcccgatcacaatgccgataggcgaacagattaaaggacgactgatgaacgtagtgggcgactctatcgacggtatgaagagtctcgaccgtacaggcgcatattccatccaccgtgatcccccaaagtttgaagatttgacaactgtgcaggaggtactcttcacgggtatcaaagtaatcgacctgctggagccgtatgccaaaggtggcaagatcggactctttggcggtgccggtgtaggaaagaccgtacttattcaggaactgatcaataatattgccaagaaacataacggattctccgtatttgccggagtcggcgagcgtacccgtgaaggtaacgacttgctgcgtgaaatgatcgagtcgggcgttatccgctacggcgaggctttcaaggaaagtatggagaagggcgactgggacctttcgaaagtagactataatgaactggaaaagtcgcaggtatccttgattttcggacagatgaacgagcctccgggcgcacgtgcctctgtggcattgtccggactgacggtagcggaatctttccgtgatgccggcaaggaaggtgagaaacgtgatatcctgttttttatcgataacattttccgtttcacgcaggcgggttcggaagtctcggctctgctgggacgtatgccttctgccgttggttatcagccgacacttgccacggaaatgggtgcgatgcaggaacgtatcacttccacccggaaaggttctatcacctccgtacaggcagtatatgtgcctgcggatgacttgacggaccctgctccggcaacaaccttcagccatctggatgcaacgaccgtgctcgaccgtaagattacggaattgggtatctatccggctgtcgatccactggcttctacgtcccgtatccttgacccgcacatcgtgggacaggaacattatgacgtagcacagcgcgtgaaacagattttgcagcgcaacaaggaattgcaggacatcatctccatccttggtatggaggaactttcggaagaagataaactggtcgtgaaccgtgcgcgccgtgtgcagcgtttcctttcgcagccgtttgccgttgccgaacagtttacaggcgttccgggcgtgatggtaggcatcgaggatacaatcaaagggttcagaatgattctcgacggtgaggtagacaacctccccgaacaggctttcctgaacgtgggcacgattgaagaagcgatagagaaaggcaagaaattgctggaacaagcgaaaaagtaatcgaaacaacattccatgatgaaagaattgcatttaagtatcgtatcgcccgaaaagagcgtattcgacggagaagtgaagattgtcacactgccgggaacggtaggatcgttttctatcctgccgggacacgcgccgatcgtctcgtcattgaaagcgggaacgttgggttataccacgatggacggcgaggagcatacattggatattcagggtggttttgttgaaatgagtgacgggacagcttcggtgtgtgtctcgtaaggaagacgagatggataatatacagcagaaaaacacaacgacatggtgaacattagtaagactaaacggaattttatcgcactgaatacgctgtttgctatactaagcggagcagcgggagcagtgattttacacatagccttgccggggcattatttcggaggatatccgtttataccggtatatttctatatcttcggtttgtttagtatttatatgttcgatgcgtgtcggcggcatgctccgcagaagttgtcgctgctgtatctggcaatgaagatgataaaaatgattctctcgctgattctgctgctgatttattgtctggcagtacgcgaagaagccaaggctttcttgctgacgtttatctcgttctatctgttgtatctgatatatgaaacgtggttcttcttctcctttgaagtgaacctgaaacggaaaaagaaaaataagaataaaaatgaaacagttgcgtaacatagtagctccgatatttctgctctgcctgatgttggtagccggtctgccggtcttcgcgcagacacaggaagatgtgactccgcaggagcagaaagagaatacggtcgatgtgaaggagatcgtgttcggacatatcggcgactcatacgaatggcatattacgacgtggggtaaaacgcacattactataccattacctatcattgtttatagttctactacaggttggcatacgttcctttcttcccgtctcgctgagaatggaggcacttatgaagggctctccgtcgcccccgaaggaagtaagtacgaaggcaaactggtggagtataatgcagccggagagcaggttcgtccgtgggatatttccattacgaaggtgacattcgctttgttgttcaacagtgtgctgctgctggttatcgtgctgagtgtggcgcaatggtacaggaagcgtccgcagggagcgttggcgccgggtggttttatcggattcatggaaatgtttatcatgatggtgaacgatgatatcatcaagagttgtgtcggacccaactaccggaagtttgcaccgtacctgctgactgcgtttttcttcattttcattaataacatcatggggctgattcctttcttccccggtggtgcgaatgtgacgggaaacattgccattactatggtgcttgctatctgtacgttccttgcagtcaacatctttggaacgaaacattactggaaagatattttttggccggatgtgccctggtggctgaaagtgcctgtaccgatgatgcctttcatcgagttcttcggaatctttacgaaaccgtttgccttgatgatccgtcttttcgccaatatgctggcgggacacatggcgatgctggtactgacttgcctgatctttatctcggcaagcatgggacctgcgctcaacggtacactgacggtagcttccgtactgttcaacatttttatgaatgcgcttgaactgttggtagctttcatccaggcatatgtattcaccatgctttcggccgtatttatcggactggcgcaggaaggtgcaaaagtaaaagcagaataaacgcgaagagagagcaaataaataaacgagaaaataaaccattttaaaactgaaaattatgttactatcagtattgttacaagccactgcagcagcagtaggagtaagtaaattaggtgcagctatcggtgcaggtcttgcagtaatcggagctggtttgggtattggtaagattggtggttcggctatggaagctattgcacgccagccggaagcctcgggtgacatccgtatgaatatgattatcgccgccgccttgatcgaaggtgtggctctgttggcggtagtagtatgtctgctggtattcttcctgtaatattaaatagatatgtcattactattacctgatagtggcctgttgttctggatgtttgtcgcattcggggttgtgttcgtgatattagcgaaatacggtttccccatcatcatcaagatggtggaaggccgtaaaacctatatcgaccagtccttggaggtggcaagggaagccaacgcccagttagctcatttgaaggaagagggcgaggcgcttgtggctgctgccaacaaggaacaaggacgaatcttgaaggaggcaatggaagaacgtgacaagattgttcacgaggcccgtaagcaagcagagatagccgcacagaaagaactggatgcggtgaaacaacaaatccagatagagaaggatgaagcgatccgcgacatccgtcgccaggtagctgtgctttctgtcgatatcgccgagaaggtgctccgcaagaaccttcaggacaaagaatcccagatgggaatgatcgaccgtatgctggatgaagtattaacccctaataagaactaaggaagatggaagtcggagtactctcaatgcgatatgccaaagcgatgatcgaatacgcccaggagaaaggtgtggaggatagactctacaacgaattcttcacattgtctcacagttttcgtgtccagccgggactgcgcgaagtgcttgataatcctgtggtgtcggtaaaggacaagttggcgctgatatgtacggctgccgatggtaacggtgaatccagcagagagtttgtccgtttcatcacgctggttctgcgaaacaggcgcgaaggctatttgcagttcatcagcctgatgtatctcgatctttaccggaaactgaaacacatcggagtaggcaaactgattacggcagtcccggtggacaaggagacagaaaaccggatccgttccgcagcagcacatattctgcatgcccaaatggaactggatactgtgatcgatccctcgatagaggggggcttcatcttcgatatcaatgattatcggctcgatgcaagcattgccacgcagttgaaacgagtgaaacaacagtttattgataagaataggagaattgtataatgtctgaaaatataagagtaagcgaagtatccgatatattgcgcaagcagctcgaaggtatcaataccaacgtgcagctcgacgagatcggtacggtgctccaggtaagcgacggagtggtacgtatctacggattgcggaacgccgaagccaacgaattgctggagtttgacaacggcatcaaagccattgtgatgaacctcgaagaggacaacgtaggtgccgttctgctgggacctaccgacagaatcaaggaaggctttatagtgaaacgtaccaagcgtatcgcctcaatccgtgtaggtgaaagcatgctgggacgtgtcatcgacccgttgggcgaaccgctcgacggaaaagggctgatcggcggagaactgtatgaaatgccgttggaacgcaaagcgccgggagttatctaccgccagccggtaaaccaaccgttacagacgggcttgaaagctgtagacgctatgattcctatcggacgcggacagcgtgagctgattatcggcgaccgtcagacaggaaaaacttccattgcgattgatacgattatcaatcagcgcaataactttctggcaggtgacccggtgtactgtatttatgtagctatcggtcagaaaggttctaccgtggcttctatcgtaaatacgctccgtgagtatggagcgatggattacacgattgtcgttgccgctacggcaggtgatccggcagcgttgcagtattatgcaccgtttgcaggagctgccatcggtgaatatttccgtgataccggccgtcatgcgctggtggtttatgatgacctttccaagcaggcagttgcttatcgggaagtatcgttgattcttcgccgtccgtccgggcgtgaggcgtatccgggtgatattttctacctgcactcccgtctgttggaacgtgcggcaaagatcatcaaggaagaagaagtggcacgcgaaatgaacgaccttccggagagcctgaaaggtatcgtgaaaggtggtggttcactcacagctctgcctatcattgagacgcaggcaggagacgtttcggcatatatcccgacgaacgtgatttctattaccgacggacagatattcctcgaaacggacttgtttaatcaaggtgtccgtccggctatcaatgtcggtatttctgtatcccgtgtaggtggtaacgctcagattaaggcgatgaagaaagtggccggaaccttgaagatggaccaggcacagtatcgtgaactggaagccttctccaagtttagcagtgatatggaccccattacggcgatgactatcgacaagggacgtaagaatgcacaattgctgattcagcctcagtatagtccgatgccggtagaacaacagattgctattctgtattgcggcacgcacggtctgctccacgatgttcccttggaaaacgtacaggattttgaacgcagcttcatcgaatctttacaactcaatcatcaggaagatgtgctggacgttctgagaaccggtgtgatagacgataacgtgaccaaggctatcgaagagactgccgctatggttgctaaacaatatttataaaatgaagacgctgtgtcaaaagtcaatagtaactgaactgggactgacttttgacacacactcattcttaattcttaatttaaatagttatggcttcactgaaagaagtaaaaaccagaataaattcggtaaagagtacccgaaaaatcacttcagcaatgaagatggtggcttctgccaagttacacaaggcacaaggagccattgaaaatatgctgccttacgaaaggaagcttaacaagattctgaccaacttcctgagtgccgaccttcctgttgaatctccttacatcaaggcgagggaagtgaagcgtgtggcaatcgttgccttttcttcgaatacgtcgctctgtggtgcttttaatgcaaatgtgattaagatgctgctgcaaacggtcggtgagtttcgtacactgggacaggataatatcctgatatttccggtagggaagaaggtggatgaagcagtgaagcgcctgggattcgaaccgcaggagacttcaccgacgctttccgacaaaccatcgtatcaggaggcttccgaactggcacatcgcctgatggaaatgtacgtatccggagaaatagaccgggtagaactgatctatcatcattttaaatcaatgggcgtgcagattctgcttcgcgaaacttatctgcctattgacctgacacgggtcgtggatgaggaagagaagcaaaaggaagaagaagtacaaggaggtgaaatagcgaatgattacattatcgaaccttctgcagaggaactgatcgccaatctgatcccgacggtattgagccagaaactctttacggctgccgtggattcgaacgcttcggaacatgcggcacgcacattggcgatgcaggtggctacggacaatgcgaacgaattgattcaggatttgacgaagcaatataataagagtcgccagcaagctattaccaacgaattattggatattgtgggtggttctatgcagtaaataactttgcacgataacactattttgtgaatcggtattccgtttttaagctttgtccggctagtaattaaataatctatatatttgaaaattatttgagaggtgagattgttttgatgggaacaaaacaaaccttgataactaacaaaacaaatatatagattatgacacaaaagcgattattcggcatttctggtgctattgctacggcagcattgattggtgggctgttggctggatgtatggaaaaagatctgtacgatcctaattatggaaaagaacctcttccggaccctagcgagtatttcggatttgaaacacgtggcgacgtgaaactttcagtaaattatgatttgcccggacttgtggctctacttgaagtgtatgatgaagacccgatggaagtagtggacaatgttccggtaaagaaagaaggggttgaagctttattcaaaattttcacggatggaaatggaaaatatgaagggaaaatgaatattccgacttctgtagagactgtttacttgtatacatcaagctggggagtaccccgatgcgtaaaactagatatcaaagatgggatggctagttttgatatgagtaaaaaggattcttctactgccaatactaaagcggtaacgcgttcttatgacttttcgaaaggtagcgtgccgtatcttatcaattccggtgctaatttgtattcattgtgtaagtggggagaaggaggaaatctcacctatatttataatagtcaaacaggaaagccagaccctattaataatggatatgtaacacctcaaaaacaagtgggtaatgaattgattggaaatcttgtagaacgtttaaactcttttttcaagccatccggaggttctgttgacaacgcttatttgtataagggatctgaaatcactaatattaatgtaacacaagagggaactacgttagatttggtctttcttgacagggacgcttcatttaataattcatttggatattattattataaaacaagtgatggagttagtaactctaatatgaggaagtatatcgtatttccaaatgttgctttttccgtatataatggagctttatctattttgaagtgtggagataaagtacgtctgctcttttggggtgaggatggtaaaccaagtgaaaaatttccgaaaggatatacagtaggatggtttatatatgcagatgggtatcatcaaaatgagaatgaaattgacattacaaaaccattaataacttctaatgggtattctaatggtggtttcgtatctgtaaaagatgaaaagagtggaaaaaccattattggtgtggaagatggagcaaacagaagtttttgtgatctactattttatgtagatgcttctccggaaagttctattgataatccgaacagacccaatatcccgagtgatgataaaccaatagaaaagccggatgcacaggagaacttaaaggggactttagcctttgaagatatttggcctgacgggggagattatgacatgaacgacgtgatcgtagaatataatcgtgccatatatttcaacacagaaaacatgataaataagattgtggatacatttacgcccacacacgacggagcgatgtatgataatgcatttgcttatcagatagatggaggacagtttggtaaagtgacttcagataaggatataaaagtggagagcgaaacgtcttctattattgtattcccaagtgtaaaacaagctgttaaggggaaagtgggtacatgtacgataaccagaacctttgaaaaggccacttttaataaggagaatctgaagatatataatccgtacattatagtaaaatatgcggcagggcaacagaaccggacggaagtacatctgcctaaatattcaccgacatcttatgctgacaaatcgctgataggttctagtaaggatgtctattacattgatcgtgacggagcttatccgtttgccatcgatattccgatgttgaatttcattccggtgacggagacgcataacattgatacggaatatccttatttcaagaattgggctgattcttggggatcaaaatctacagattggtacaagagatatcagtctcccaagaattaagaaacaaaaacaatttcgatatataactgtgacacgactttgtgttctgatttgatccggtcccggtgtacttcaagcgagaagataccgggaccttttttgtttatttgtatacaaatatttcgggagtaaagaaatgatgatgaaaataccggcttgattattgcttttccttacattcaatttcggtggttggaatctattcagtacctttaccgaaaattagaggaaacatggaaaataatcctgaactacaactagcttggcagttcattgaaaatacaggcacgcatctgtttcttaccggaaaagccggaaccggaaaaactacatttctaaaacgattgagagaacatacccccaagcgcatggtcgtattggctccaacaggaatcgcagctatcaacgccggaggggtgacgattcattcattctttcagttgtcttttgctccgtttgtgccggaaacgactttcaattctgccaagatgcactaccgtttcagcaaagagaaacggaatattatccgcagcatggatctgcttgttatcgacgaaatcagtatggtacgtgcagatttgctggacgctgtggacgcggctttacgtcgttatcgtgaccgtgaaaaacctttcggaggtgtgcagttgctgatgatcggcgacttgcaacagttggctcctgtggtaaaagacaatgaatgggagctactgaagaatcattacgagactccatatttttttgccagccgtgcactgaaggaaacggtgtatatgaccattgaactaaagaaagtctaccgtcagagtgatactttctttctttctcttctgaacaagatacgcgaaaataaagcagatgatgaagtgttgaacgaattgaatcgtcgttatcagcccggttttcgtccacggaaagaagaagggtatatccgactgacaacgcataactatcaggcccagcaggtgaacgaccgtgaactggcatcactgtctggacgggcttatagttttcgggcggagatagagggaaattttcctgagtactcgtaccctgcggatgaagtgcttacagtcaaagaaggagcacagatcatgttccttaagaatgacgtttcatcagaaaaacgttactataacggcatgataggcgaagtgatgagtgttgacgaaaaaggaatgtccgtacgtggaaaagacagtagtgatgtctttcagttgttgcccgaagaatgggggaattataagtatgtgctgaacgaagaaacgaaggagatcacggaagaaatagaaggtgtgttccggcaatatcccatccgtctggcgtgggctatcacgattcataagagtcagggtctgacgtttgagcgggcgattatcgatgctcgtaactcttttgctcatgggcagacgtatgtagcattgagccgttgcaagactctggaaggaatggtgttggagactcctttgcgtagggaggcgataatcagcgatagcattgtagataatttcacaagagatgtggaacagaataaaccggggagcaagcagttgaacgacatgcaaaaggcttatttctatgatctgttgaatgatttatttaatttctattcgcttgagcaggcttataagcggttgctccggatgatggatgaagagctttataaactttatccgaagttgcttgccgagtataaagaactggctccgcatctcaaagagaaggtggtggaagtttccaatcgctttcgtaatcaatatacgcgtctgattaacgggaatgaaaattatgccggaaatgaggagctacagcaaaggattcattctggtgctacttatttctgtgaagcattgcttcctgtccgggcgctgtttgacaagaccagtatgcctcttgataataaagagttgcggaaacaactgaatgaacgtttgcaggcattggacgatgctttatggattaaagagtctttgctggatgcgatgcggacggagaaatttatggtaacggattatctgaaacggaaggcgaaagtgatgttaagtctcgaaggggaaactgcttcttccggttcttctaccaaggctccgaaggagaaaaaagaacggaaagaacgcactcgcagcaattcaggaaaggtgaaagtagaagttccgacggatattctgcatccggaactttatcgtgctctgtcggaatggagaacggcaaagacgcgcgaagtgaatatgccggcttatgtgatcatgcagcaaaaggcattgatgggtattgtgaatctgttaccggatacaccggtagctttggaagcgataccttatttcggtgcgaaaggagtggagaagtacggacttgagatcttgggcattgtgcgcaaatatatgaaggagaacaaactggaacgaccggagatctttacttctgtttcggggaaagaggatgcaagggaaagaaagctggatgcacagcataatgaggagaaagagaagaagaaagattcaaagctggtgagttatgaaatgttttgccaggggatgacgatagaagagatagccaaagctcgtgatttggtgacaggaacgattgctactcatctggaacattatctccgtgaagataaaataaagttggaacaggtagtgacagcggacaagataaagaaggtccggacttatctggagacccatgaatttatgggagtggtggctattaaagctgcattgggagatgacgtttcttacgctgatattcgttttgtgttggcgacggcggggcattaaaaaactcattttaataaaaaaataatgtccgaaaagctactgacagaatgataggtcagatatgcttttcggacattatggtatgatggggtacagagttataagttacagaagaaagaaacgaatacaggcacgctgatatcgatcagaataccatgcaaaatagcgataggaatcatttcttttcccgaatatctgctgatggaaggtaataatacatccattgagttgactcctgccgctgaaatgggagcaagtttcccgaaatacttcttgataagcggtgtacccaaaagtgccatcatttcgcgaaagatattagtcagcagggcaatggtacccagctctgtagccaactgtattccgatggtcggttccttgaactgagtgatcaggatggaagacagcgaataataggcgaatccgcttcctactgccatacagtcgaatacactccattgacttagcaaaatgcttgccaaggcagaaaacaacaatgtgccggtaatggtacccaatggaatcagcagcattttcgggtgcaaatgtgagatgatcgctttcaggttcttattggaaccgatgctgattcctacttgcagcatcaacgcatatagtatatacatggaaacagtatgtgtgtcgaactggaatttattaaaaactcccatgatacagcctacacagaaaaatacgataacgatgagacttcctttcattgtttacctcctttcttgaaaaatagttgtaacacaagccgggcagccaacaagctccctaatacgccggatacggcaagaatgatcgcctgccatccaaacttaccgagattattcacaatcaggctattagagccaatggatactccaaggataaagagtaacaggaatattgtaagagaaattgtcttttcagtcttttgtaagatactccagttacgtaatccgtatccgataccgattcccaaaaacatggtagatataatagagaacatattgtaatatattttagttggttaggttaaacaattcataaatagcatagataatccccaaaaagacatacatcttattgacaatcagatggaaatactgtctgtgagtaacgaaataagtcaacaggcagttaggggtaagaatgagtaaggggaatttagatgaatccgctgaaccaatgtacatgcacgcaacatgacgtgcagaaattgggaatttccgcatgaaatataagggcgttatgtaattgtaatgtttgattcatcttctggttctttaattcgggtgcaaagataagaacttattgcatattttcaaaataaatatgcaataattagaatgggaaaggtagctgaaactaggaatagaatgtagtaaaaacttggttatgtagaccttaacctttatatattatgtgtttatatcatttttatttagttgccagttcgatgcctgagtcaaatttctatgttgtgtagagcacatacttttatttgtgcaaacaatctgattaataggatttgtcggttaatgtttccactccatgaggatgtctttcagctttcgtggctggtaaccaagtatagtccgggcttttgctatactcatcccactgaaacggggacggggagtagcttcttgcatttcttctgttgtggcagggtgaacgagcgaacggtccagcttcatgtagtctgctacctgaaaagcaatttctgcgatggtcaggcattcctcgccacagatatgaaaaattccgtttgcggcattttctaccaggtgttgtactccggctgatacgtcacctacataggtgggcgtgcgccattgatctgatacgacacggatttcttgtcctgcattcaaacgattcatcaccagttgcacgatgtttccatgttgtcccggcaatgcttttccgtagacaatctctacgcgggcaatagcatagttactacagatttcagtcactttctcttctcctttccatttggtgaaaccgtaatagttgacgggagcagggagacttttttctgtataaagctgtccggacttctcgtctatctttccgtcaaagacgaagtctgtagataaatgaatgaaccggcttttgtaactttcgcaaagatgtgccaattgttctactgccgtaacatttgttagccaggcttcttcgtgatgcgtttcgcaataatcggggacggataaggcggaacagttgatgactacatcgggttgtacgtctttaaaaagttgctttacgactgcttcatcccgtatatctgtggtgatgaaatgatagttgcctccattcttcggaaggatatccggatgcagggaacatcctgttaccttatattgtgccttgctcgacaggtcattcagtatttggcgtccggtgaatccattggcaccgataattattatattcttcatgggctgttttatagtcgttcgtttcagtcatatgagtttttctcagtcacatgagtgagtttcggttcagaaatggcttttctatatttattttcacaaaagtagaaaataattttagttacgcaaatagatttcgtagttccctttttcttttgctcttttgcgaatttaagcatatcattatcaggtccgatgcgcatgccggatggattggatgaagtaccgggagcttacaaagatattgcgcaggtaattgctaatgagcgggatttagtgaaacctttggtggaattggcgcctatggcggtgatcaaaggataaaattagctgacgagatgaggtatggacataaaaaaaggagcaacgccttgctccaacctttgttaaccttaaatctaatactatgaaaaacacattgcaaagatacggacttctgcgaactttgcaaattatccaagaataatagtatgttttataacattgattaagaatttgaattctcaattctatttttattaagagatttcctgatcttatcttttgttcttaatgagtagctgcataccatgctgtttcttctttttttgaggccagcgagtgcgtacttggatcggagattgtaataccggagaaggtattgattttcacttctcctctgctcatcgaatagaaatattctgtatttcttttgaatggcaccgtacgattgagctgttcgttgaatcgtgccactagagtttcatcagggcataattttgaaacatagtcaccatagtcaaagaagataaccggataatatccgtccagtctctgtaaagaactggttagtgaaggatcaaaagtatatcgatgattaatttctttcataatagttgccaggttatcaagttctgagcaatcagtgacagcgattgttccgcagggtgtgctataagtggaataaaaagagtaaaaaccgtcacagataccggcataatctactttcccaattagatactgacctatctcggcgtatggcataccatacgccatcacttcacttgtagatcctatcagataatcagtcacatctttgagagcgtaggctacttcaatgcttgacatatagcagtcgtcaaagagtatatattccattttaagtccggcattggatattcctttggcaagtgtggttatatcagtctgatattgggcatttaatcctccgaagtagcgtgtcattggtacattttcgtattcccagtgcattttggtacgaagaccgctacgtgatttagaatttgatacgggtatccatcccatgccatgacagccgataaccatcgaatagcgtttggtgggagagtagcgttgcacatcatttaggatggatgtgataccttctgctgtggtatatgcaggatctgtatagttctttagagttttatgcacactcttgccattctcataagcgagttcaaaaagagtggctttcgttgctgtggtacacatgaaaatgattatccgttcatccttcaagatattcttttcaactacactttcaaggtcgctgatgttctgatagaaattggatgtgagattatcagaccaggggagatacatgaataccgtttgttctgtaggtaccggaactggctcttccttttcgcacgaagtcatgccaaaagaaaggaatagtacgatgataactgatttaatcaaatggtgatatttccgctctgtcttcattgttttgtcaggattaaagttacttcttgatatataacgtaaaaagagcactttttgatttatatattcagaatataatctgaatgtatccttttcaagtgttactgcaaatctactgaaaaataacgtaattctactatatacgaaagtccaatagctcacgtatggacataaaaaaaggagcaacgccttgctccaacctttgttaaccttaaatctaatactatgaaaaatacattgcaaagatacggacttctgtgaactttgcaaattatccaaggaaaatagtatgttttataacattgattaagaatttgaattctcaattctatttttattaagagaaaagtcagttaggcatcttgaaatcattcggcaaacaaccggtgatcttcttaaacaggcggctgaaatattgcggattccggaaaccgagttcctgcgctatctggctgagtgttttatctgtatttatcaaccactctttagctatctcgaaacgcttgaactgaaggtattctttgtacgacttccctgtttcatattccagcaaatcattgaaatatgcgggagaaagacgaagtactctgacgcactcctcaatagtgggaagatcggaggactgactttgtatagtattgaaatgatcatccaaaagacggtcaaaccgttcgataatctttttgttagcctcattgcgtgtgatgaactggcgttcgtagaagcgttcgcaataatcaagcagtagttcgatgtatttggaaatgatcttctgactatagcagtcgatgcagcgttgcaattcttcatttattttatccagaagttccagtatgacctgtttttcacgtaatgaaacatgcagtgcttcttcgggacgataagagaagaaagtatagtcacgaatgttcgctccaagcgcagtgccgcagatcaagtcgggatgaaacgccagtatccatcctttggaaggacgtgtgttgtcactatccttcatactgattgactcgccgggagtcagacagagaagtgtcccgtccgagaagtcgtagtactgatgtccgtatctgtaggcttcacatttgcattcgctcaacagaatcgtgtaaaatccgaatttgaaatccgtatgggaggataaatcggcttttgaaaggtcgatgacactgaccagagggtgcagtgtcttactccccatgcagcaattacattgatgcacacttcctatcttaagtactttatctcccatgacgtaactaatatcctgattaatggagctgttttagttctgttgcttatattcgtttggcgtacatccgacattcttcttgaacaatcggctgaaatgctgcggatactggaaccccagttcatacgcaatctggctgaccgtctggctaccttctaatatccgttccttggcaagttctatgatccggtgctggatatattcctgtgccgtttttcctgtttctttcttgatcaggtctccgaagtaattggaagaaaggcagactttgtccgcaaagtattttacagaaggaagtccttcggtaagtgcagtctgattctgaaaatactcgtccaataactgttcgaacttcacgatgatatctttattcgcctgattacgggtgatgaattgccgttcgtagaagcgcatgcaatagtcgagcaatagttctatattgcggacaatgagctgcttgctgtgtttgtcgatggcatgttccagttcgatttgtattttgtggatacagtcggtcacgatttccctttcctgttcggagagatgcagtgcttcattcacttcgtaagagaagaaactatagtgtttgatgttctgccctaaagaagttccccggattaaatcgggatgaaataaaaggccgatagattttgtacgaattggtgtctgcttgcggttatctatcccgataacctgtcccggagccatgcagacaacggttccttcctgatagtcataatacttccgtccatatctgagatcgccacattttgcgtctttcagaaacagagagtagaatccgatattcatacgatagtagtctaccgtctttgtcgctttcgagaagtcgatcacgtttaccagtgggtgcaaggtctctagtccgaacagttggtcatactggtcaatgctttcaatttttgttatttcttccatacggcttacagttttgatctgtcacaaagataaagcttttaaatgtatctttctcattccgtatttgcaaaacagtaatttgggtataagattcagtaatttgtatacaatgccggtgggtagtgggatgcaaactcacttttttcagctaaatatcagcgtgtcggaaacaaaaaaacgggataatcaagggatgtgaatagtagaattaatatatttgttcctgtgaatttaaaaagacttgttttatgaaagcattattcattggaggaaccggtacgatcagtaccgatgtagtagaattggctcaacagagagggtgggagataacactgctcaaccggggctcaaaaaaactgccggaaggtgtgggcagtatcattgccgacattcacgatgaggaagctgtggcgaaagctattgcagatgaaagttatgatgtcgtagctcagttcatcgcttacacggcagaagatgtagaacgtgatatccgtctgttccgtaataagacgaaacaatatatttttatcagcagtgcatccgcctaccaaaaaccgttggctgattaccgtattacggaaagtacccctttagtgaatccttactggcaatattcacggcataagattgccgccgaagaagtgttgatgacagcataccgtaccaccggtttcccgattacgattgtccgtcccagccatacgtataatggaacgaaacctcctgtaagcctgcatggaaataaggggaactggcagatacttaaacgtatccttgacgggaaaccggttattatccctggtgacggaagttccttgtggacactgacacattccaaagattttgccaaaggatatgtaggactgatggcgaaccctcatgccatcgggaatgccttccatatcaccacagatgagagtatgacttggaatcagatttatcaaaccattgccgatgcgctggggaaacctctgaacgcactccatgtggcttccgattttcttgcgagacatggcgggaactatgactttcggggcgaactgttgggggataaagccgcaacggtagtctttgataattcgaaaataaaacgccttgtgccggactttatctgtacaacttcgatggcggacggtttaagacagtcagtgcaatatatgctttcgcaccccgaaacacagactcctgatccggagttcgattcatggtgcgaccgtgtagccgacgcgatggctgcggcagacagagcttttgaagcagaataaacgttagttgagtaaataactcatcttgttattgatgattgaaatatcctattagcatatcctgattagctattagctaatcggattatgctaatagctaatcaggatatgctaatagccgaaacaagtcgatcataatgagtagcgtagttaataaagaccgttccgtccctgctgaacctcgatccggataccgaaattaccattggaggacttcagttcgaatgctccccggaaattattcttctcccaaggcatggcactacggttgggcactttccatccgtctttgtcatagtctccgtatgtattgattttccatccgtttttcagtttgaaggtgcccatctgcatgaactgcggtgaagacgacaatccccagccatacccatatccgaaaccggagaaaggggaagaaaatgcgtcggtgaatccctgtgtatagctggcgtctgtattcagacggaatatctgattatagtctttactcacatccggtacatcgagactgaatttcggaagtttgggaggggccacattcattaatcccatatcgagcaggaagccaccgaattcctttatattgctcgacggagcacgacgaatactatcggaaggaacctccgactgtgcggatgcaaaaccgaccgataatatcagcgaaagaaatagaatcagttttctcatcttcgtaaaggttgattgatgacaaagatagagatttttagtctgactgcctgcttccgttatgttttcttagagaaaaatcctttaaaaaggagtgtgctgctgtctcgtcgggatggtgtcactatcccactaagatagtgtaagtatcctgtggggatagtgacactatgccagtaggatagtgacactattttagagcttagtttgcaatgagtttatagccgattccccgcacattgacgatacgtatttgctcatcctgcgacaacttatgccgcagtttcgtgatgaatacatgcagactccgggaattgaagaaactgtcatccccccaaagttccagcagaacgtcctgcgtattgaccacctgattccggttttcacaaagccgtttcagtatttccgactcgcggtgggagagttcctgtctcactccggcatgcagcaatgtctgcgcgaccggatcgaacagataacttcctatctcaaaacggctggatacctttgtcttcgtgaagctgaacgcttttcccatcagcgccttgatacgtatgatcagttcctgcatgccgaaaggctttttcagataatcgtttgccccaagttcgaatccttctaccacatcgttgatggccgaacgggcagtcagaaacagtacaggtgtctgcttgtccgtctgccggatgcggcgtaccatttcgaatccgtccattttgggcatcatcacatcggccaccagcacgtccggccgaagttcaaagaaaagatgcaatccttcttcgccgtcggaggcggtatgtatggtaaaaccgttttcctcgagcgtatctttgataatcatggcgagtgtcagttcgtcttccaccaacaatactgtaatgtcgtttttgctcatggttctgatgttttagatagtaatggtaaatgtacttcctttgccggattcacttttgacggtgatggtgcctccatgtttttcgaccatgcttttgacatagaaaagccctaagccgtatcccttcacgttatgaagatttccggtcggaacgcgatagaatttgtcgaatatatgtttctgtttatccagagggatacctattccatgatcagagacggtgatagtcaccgtttctcccgtttggcggcactgaatcataatctctgcttcttgtttcgaatatttcacggcattgtctatcaggttactgatgatattgctgaaatgagtgcggtcggctactatcgtcagtgcttccggttctgtttccagtgttatgtgtacggggatatccgcttttagctggtgctgctctattaaagaagtaatcagttcttttagacaaatctcttcggggtgcagtctgaacgtcttgcggctttccatgctcatggaaagaatctgttcgacgagtccgctcaaacgctgtagctgctcttggctgatgcgcagatattggtcacgtttgcttttctcttccgcctggttgaaattcagcagcgcatcgttggcggcatacgccacggcaatcggagtctttaactcatgcgtgatgttgttcgtaaagttgctcttcatttcttccagcgtcttttgtttcagcagtgtccggatgaggaaccagaaggaaaatccgaggatgaggaagatgacaaatgaagtgaccaggatgccagtcatttgtttccataccagggaggtgatgggttccattatcagttggtagcgttgactgtgatgcctgttgaattcgtagttgtagcggatggctttcgggctggggatataggtgctgtctcctgcgatgcccagtgtatctatgaatgtctgggatgaatcctgagtagctccgctgtatatatataaggtacggtgaggcacatctatgttgtgtgctttcagtacatcggtcagtagactgtcatatttttgcaggttgatgtcgatgtaggtatccacgccggagtgcataccctgttggacgctgagtatgagttctttcatcgagtcctgtttctttaataatacatcaagtccgctttcgctggaggcaacggcgctggcatccggatcgttggcattgacggctagggtatctactgctgtttccgtgcgtgtatgcagggtgtctttgtaggtactgtccgtataagagacggtctggcttgtcaccagcgacttgccgtctgcaccatatccggcggaaacggtgaccgaaccatgttccacattatccttttgcagctcgttgacgcgaagcacgatttcattaaagtcgctcgtacgcatggcgtctttgatattattgttcatttcctgcttcatcgtgcggtaaagccctgtcagccaatatgtctggtaaacaaagatgcctgtcagcgagcagatgacaaggataatgatatgtttcaacggtagtttcatacggacaaagatagtatgaaactgttatttttcttctctttgataagactaaataacactagataagccggcgataacgtaaagtttcgttttttctcccgtattttgcagcatactcaaaaataaatgcgatatgaaacgaacttatttactgcttttgttacttttcatgtattggatgtacgcttctgcacagcaggtacagacagcgcaggaacctgccgacagcgtaaaaaacgtagcctatatagacagcctgtatcgggaacttcccgaagtcatgatcaccggcgaacgtccggtagtaaaagccgaacaggggaaactggtatacgacgttccgagactggtcagcagcctgccggtagacaatgcctatgatgcggtaaagaacctgccgggagttgtctccatgaatgatgccctgacgttgggagggcaaccggtcactgtggttatcaacggaaaagtgaccaccctctctgtagagcaattaagcaccctgctgaaatcaatgcccgtcagtcggattgaaaaggcggaagtgatgtattccgctccggcacgttatcaggtgcgcggaccgatgatcaatttgatactgacttcgggcatgggaaaagaaccttctcttcagggagaactatatactgcctacagccaattacactacgaatctctggcagagcgtgcgagccttctatactccggacgcaaattttctgctgatcttctctactcttactcttacagccgcgaacggagggagacagacaaggaagcgcttcacacgctcgccgacggttcggtgcatccgatgaatatgtatgatatcactacttcccgccacaacaatcaccagatacgccttgggatggactatgcctttaccgacaagcatttgctgagcttggtttataccactgctttcaccgatgtcaaaccttacgccacagtcaccggtgcgcagaactcggtcaccgattcgcactcggaaggacagctccataatgccaaactcgactatcagactcctttcggactgaaagccggagcggaatttacctattatcatgctcccggcagtcagctgctttacagcacactgggagaagaaacactgaacttcctgagcaaagataaccaacggatcaaccaatggcgtttctatgccggacaagaacatactttgggcgcagactggggattgaattatggtgttgcttatacgaccgcattggacaatagttatcaaatgtatttcgatcccgaaacggaaactttactgccggacaacaacatgcaatcccgtcgtcgcgagcagacgctgaacttttatgccggactcagcaagagtttcggtgagaaactttcaacggatgtctctctggctgccgagcaatatcatacggatatgtggaacgaatggagcctgtatccggttgccaacctgacttatttgcctgctccgggacatatcctgcaattttcattgagcagcgacaaagaatatccggaatactggagtatgcagaactccacttcctacatgggtgcttattccgaaattcagggaaatcccttccttaaaccggcaaccaattacgaagctaacattagctatatattaaaaggtaaatatgtgctgaccgcctattacagccgcacgaaaaacaaggaaatgcagacgctttaccagtctccggaacgtctggtcgagatatataaatgctttaacttcgacttctcggaacaggcgggcttggtaatggtagttccctttaaagtgaagaaatggctggactcccgcatcacggcaatcggctttcgttaccgtcagaaagacagtgatttctgggatatcccgttcgaccgcaaactatatacgtttgtattgacaatgaacaataccttcactctctccaccaaacctgatttgaagtttaccctaagcggattttatcagaacaaagcgatacaaggcattttcgaccttccccgttcgggaaatctggatgcggccctgcgctatactttcgcaaagggaaaagcacaactgaccttgaaatgcgacgacatatttaatacttccaccatttcgactaatgtccgtttcggacaacagaatgtgaagaatcactatatgaagactacccgtgccttcggtatttccttcaactacaaattcggaggatacaaggagaaaaagcgggaagaggtggatacttcccgctttaaataataagtattacctattttctgcatactcatccagtacgcgcttgatactttgtcctatttttacgtaatcggcttcgttcagattggcgagcgaaacacggacactccatttcggtccggcaaatccgccgccgttcagcaggacgagcgaagtctcgttggcaaggcggaaaacaacgtcgagcggattgtaggtcttttgcagatagtctgcaaattcatcaccgtagaatttcttcgcccataccagcatgtcgatttccgaataatatccggcacgcagcgggtcttctatcaacgtgaagccggtgctgtcccagagtgcatgcagtcgacggtggatgatttcctgcatctttgccttgtaccggtcttccttgtcgagaagggagaaagcggcgaacaggctcatctgcatttgctggggcagcgagagtcctgcggtatggttcagcgcaatctgccggctgtcggctaccatgcggtcaataaacttcatcttctcggggtgtaaactgaggcttgcataacgcttgtttaagattgctgtttgctcctccgacaggcgggcaatcattttgtcgtagatgttgtcttcgtgtagggctatcactgcatttctccatcctgtggctccgaaatacttggagaaggaatagacgcagagtgtattatgcggcaattccgccatcaacgaacggaagtgaggtatgaatgttccgtacacatcgtccgtaatgatcatcagattcggattgtcattctttacgatgttgacaatacgtgcggcagtctccggactcagcgcataactgggcggattgctcggattggtgatgaacaacgcttttatctgcggattcttcagcttatcgatatcttcatctttatattgccaggtgtgcagcccgtccggtgtcatctgatcggcagatatttcggtaacatcgaactgatagcggcgtaattccggaatctcgatgtagggcgtgaagacaggaatcatcaaggcgatggaatccccttgattcaacagaaagttttcctgcaatgaatcgaatacatagcacatggcagccgttccgccttcggtagcgaaaaggtcgaatgtgcctttagggggacggcggtcgcacatttcctgtgccagataatcctgtacgatcagttcggtgaagtgcaggatacggtcggggacaggatactggtcgccgatgaccgattccgcccattcatgaaccagtctgtccggatcggctgcgtgctccatcagcatataattataggtttctttcagtaacctggctccggcttctttctcgttctctttgaggaaagcctcgaagcgggcggctattccttcctgttgtgggatgcctgcaattccttcttccagggattggacacggcgacattcgcaaagtccgaattttcctaacaggaagaatgcttcacgcggttcggtcgcaatccagttcgggttgcctcgtcctgcgttcagcatggtatgggccattttcttgatactctcgtcagccatttcgatgagcttgtttttaagttcgaaagggctgatcgtttccatctttttggcaaagttcttggtgataactgtgccagttgttttcttttccataatggttcttattgttttgatacttaattttgatttcctatacattcattatactgacatttacatgagcaatacgatggctactccccagataatcagtagtgtattaccgactgcatacgtcacggtgtatcctaacgcgggagtgtcgcttcccaatgcatcctgaatagctcccagtgcggcggttgtggtacgtgctccggctgtacatcccagtgtgagggcagggtggaacttgaacagatatcttcccatcagcagtccgctgagaagagggatggcggttgccagtgcaccgacgataaacaggctgaatcctacttctttgaaaccggtcacgaaactaggtcctgcagcgatgccgacaacagcgataaacatattcaatcccacattattcaatacccacaacgaaggttcggggataccgccaaaggtcggatgtttgctgcgcagccagccgaatacgagtcctgcgatcaaggcacctccactggtggacaggctgatcgggatacctcccaggtgaatggcaagtgcgccgaccagaccaccgagcaggatacccagtcccacgaagatcatatctgtctggttggtggggcgatcgatatagcccatctgtttggcggcagtttctacttcgagttttgttccggtcagttcgagaatatcgccggagtcgatcactgtctgagcgagtaccggaacattgatgcctgctcgcttgatactgcggatactgactccgtgcatgaatttcagcgcacggatcgtggagaccttttcgcctgcgaatgtgcggtgggtgaccattaccggaagcgtctctgccggaaagtcgagcagttgggcgtcgatcacttccggaccgatccagtcttcttcgccgattgcatattcacggcggccgcttaatacgacttcatcgcccggttgtagaagcatatccggggtgacttcttctatgacgcccttttgccgtacgcgttctacaaacagccgtttatcgttttccaccagatagttctccagttcgctgaccgtttttcctttgccgaaccattcgttatctattttataagcacggaatacgacggggcggagggcggtgtaaaatccgggttcatctgcttcggaagttcccattttggcttccagctctttgcagtccgctttcaccttctccagtccgcccagcattttgggaccgagtgaagccagaatccatgcggaacctgccgtaccgaaaatataagtcacagcgtatgctacggggatggcattgataaatgtcgctttctgcgcatcgctgatgcttaattgattgatcgtgtcgcttgccacaccgattactgcggaaatggtctgtgagcctgccagcaatccggcagcctcgcctacatggtagcccatgattttggcaagtatccatggggcgatgaggctgacaatgcacatcaggacggcaaatcctacttgcggcaatccgtctttcttcaatccgcgaaagaattgcggacctaccttatagcccacagcgaataaaaacaggaggaaaaagacagctttcatcgggccgtctacactaatgtttaattgtcctaccagtactccgaccagtagcacgctggttactgttcccaacgaaaattttcctattttgaatctgcccagccagaagccggcgaataaagtgaggaaaatggcaagttcgggatgatccctgagttgattaataatccattccatatatgttgttcttgtttaggttatgttcataacaacagttcttgtgcaaaaagagtttagtgggttaagtacgttatcgtcatagtttctaaaaatataaattaattgtgcggaagtcccgggtaaacgagagagcgtcttaaatttctcagtttcgcttttttgttatacttttgtcacttcaaataaaactaatcatattctgtatgaaatcagacatagaaatagctcgcagtgtcgagttgaaaaagatcaagcaagttgccgaaagcatcggaattcctcgtgaagaagtcgaaaattatggtcgctacatcgcgaagattcccgaacaactgatcgacgaggagaaagtgaagaaaagtaaccttgtcctggtaactgccatcacagcgacaaaggcgggtatcggcaaaactacagtatctatcggtctcgccctgggactgaacaaaatcggaaagaaggcgattgtcgctttgcgcgagccgtctctcggtccttgcttcggtatgaagggaggagcagcgggtgggggatatgcacaggtgcttccgatggagaagatcaaccttcattttacgggagactttcatgcgattacttccgcgcataacatgatttctgctttgctcgataattatctttatcagaatcaggcgaaaggtttcggattgaaagaaattctctggcgtcgggtgctcgacgtgaacgaccgttcgttgcgcagcatcgtagtcggactcggacccaagtcgaacggcatcacgcaggagtcaggcttcgatattactccggcttcggaaattatggccattctctgcctttccaaagatgtggaagacttgcgccgccgcattgaaaatattctgcttggttttacatatgatgaccagccttttacggtgaaagatctcggagtggcgggagctatcacggtattgctgaaagacgccatccatccgaatctggtgcaaacgaccgaaggtaccgccgctttcgtacacggcggaccgtttgccaatatcgctcatggctgtaactctattcttgccaccaaactggcaatgtcattcggtgactatgtgatcacggaagccggattcggcgcagacctcggtgctgaaaagttctataacatcaaatgccgcaaaagcggactccagcccaaactgactgtgattgtcgctacggcgcaaggactgaagatgcacggtggtgtcagtctcgaccgcatcaaggaaccgaacatggaaggactgaaagaaggattgcgcaatctggataaacatattcgtaatcttcgctccttcggacagacggtagtggttgctttcaataagtttgccaccgacacggacgaggaaatggaaatgctgcgcgagcactgcgaacagttgggggtaggttacgccatcaataatgcgttcagcgacggtggtgatggagcggtagatatggcccgcctcgtagtcgatacgatagaaaataatccgtccgaacctttgcgttatacgtataaagaagaagacagcatacagcagaagattgagaaagtggctaccaacctttatggagccagcgtcattacgtacagcagcatcgcccgcaaccgcatcaagctgattgagaaaatgggaatcactcattatccggtttgtattgccaagacacaatactctttttctgccgatccgaagatttatggcgccgtgaataatttcgagttccatatcaaggatatagtgattaataacggtgccgaaatgattgtagcgattgcaggagaaatccttcgtatgccgggattgcccaaagaaccgcaagcgttgcatatcgacattgtagatggtgaaattgaaggactgagctgatttttactatttcatttagtatatttctgtactgtcaatcatccaatataaatccccgtctttccacttctgatagtttgggaagacggggatgattgtatatagagtccagtgtaccggtatgttgaccttgtctgatacactgtacgattgaagtcgctgctttccggaagagtatagtgcgtatttcaatttctctttttgtagtaagaaaacatcttttcgagcagatagtttgtctgattctgttaataaataaaaaagaaaagcctgttttcttcacagaaagcaggcttataaaattcaaaagaaattctttatgaaatgttgaacacaaatgctgctaattcacattaccggcatttggttactcaaagaaagaaatcttaatcagcaaaaagaggatatttcttcattgtctcattgacacgtgcacgtacttgtgcgatcacctcttcattttccacgttagacagaactgtttcgatcatttcggcaatttcgatcatcaggtcttctttcgcaccacgggttgtgatggcaggagtacccagacggataccggaagtttggaaagcagaacggctgtcaaacggaaccatgttcttattcacggtaatgtcagcagaaactaatgctttttctgctaccttacctgtcagatcagggtatttgctacgcaggtcaaccagcatggagtgattgtccgtaccaccggaaacgattgtaaaaccacggtctatcaaggcctgtgccagtatggcagcattcttctgaacctgttttgcatattccttgtattccggttgcaggatttcaccgaaagctacggctttggcagcgattacgtgttccaacggtccgccctgtacacctgggaatacagctgaatccagtaattgagacatcattttgatttcacccttcggagttttctttccccaaggattagggaaatcttttcccatcatgatgaccccaccacgaggtccgcgaagtgttttatgtgtagtcgaagtgacgatgtgtgcatatttaaccgggttctccaacagtccggcagcgatcagacccgcagggtgagccatgtcgatcatcaggatagcgcctactttatctgcgatttcacgcatacgtttgtagtcccattcgcgggaataagcagagccgccgccgataatcattttcggcttttcgcgcaaagcaacttcttccatctggtcgtagtctacacggccggtttcctgattcagattgtattcgcaaggagtgtagataatgccggaagtgtttactaatgaaccgtgagaaaggtgtccgccgtgtgcgaggtttaatcccataaacttgtcgcctggattcaaaacagccagaaatacggctgcattggcttgtgctcctgaatgcggttgtacgtttgcccattcggcaccgaagatttctttcaggcggtcgatagcgatttgttcgctttggtcaactacttcacaacctccgtagtaacgtttgcccggataaccttctgcgtacttgttagtcaggcaagaacccattgcctgcattacctggtcacttacaaagttttcagatgcaatcagctcgatacctttcagctgacgttggtgctctttttcgatgatgtcgaaaattaagtcgtctcttttcattctttttataagtaatattaaatttttaattcgagatacctattttaagcgcacaaagttagtgaaaataaataaagaacgaaggaactataagaaaaatgttagtaaatggaggaaattaatagataatggataatttatcgtacggaatgaataggaggtgtctgtttttgccggttgccgactatcaaaagttcatcagccggctgtcggatgttctttaaagaatgaatccgaacgagaaacttaatgcgctgtcgcggcggcggaaaatgatagggctgactcccgtgctgccgtctgaattgatattgtcataaacgatggatttggagatatttcctatcccctgttcgtagcggaagtcgaaaaagatgcgggagatattgacgccgacaccgatcacgacgctgacattgagcggatacagcttttcatgaatccctttctggtcgaagtttgtgaaagtgatttcgttctgctttccccatagataccggagttttggaccggcaaagatagacattccgtatggtcctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgacattataggatgcttccggctgaatgaaatgcttctttatattaaagcgcatgaagatcgcgccaaaatagccgatcttataattattttgtacttcgtcgatcgttacgtctttgattttcaattcggataccataaacatggaagaattaaatccggctttgataccaaagttgattttctttgtgttgggacgttccactttatctgcgttacgatcttgggcgaaagctgtgcaagctatcgccatccaaccgaaaagaattatgttgcgcagtatattcatggcagtacttttttctttatttcttcttttctacactccagccgaatttccctattttttctcccaggtcgtaatatcctccgtgcacatataccagcgggttcgcttccgccagttcgaacttgccggtttcgggattcaggttccggtcgtctgcacggacgtttaccacatcggcgataaacatatcatgcgaaccgagcgaaacaatttccttcacgcgacattcgatgcagaggggagactcttcgatcagcggtgcgctgactacggtgcagcgtcccggagtgagtttcatctcttcgaatttacgataattccgtcccgaacgtactccgcaccagtcggtagggaacgccatgtctttagttgtcagattgatgacgaactccatattcttcttgatgatgtcgtaggagtgtcgttccggtcgtacggatatatagcacatgggcgggtttgtacaaatcgtacccgtccatgctactgttataatattatattcactttcatcttttccgcaactcaccaatatggcaggcagcggatagatcatcgttcccggtttccagtcttgtttcaatttaataaaaaattaagaatgaggaatggagaaactagaggatggtgatttcctcgcgtttctgttctttctcgcaataatggcacttcacgatgcaattatccttgtctatcacatgaaataacgtaggcataggttcattgttcgtgatacatttcggattggcgcattttacgatgccgtgcagttcgtccggcattctgacttctttcttttcaacgacttcatagtcgcggataatgttcagttttacgtaaggtgctactaccgatatgcggttgatttcttcgtcgcagaaaaacttgtcggcgattttgataatgccttttttccctagctttttgctgtcgaggttgaagccgatggtgatgttacacttcatttgctccacgcccagtagctgtacgacagtaaagagtttttctgatgggatatggtcaatcactgtcccgtttttcagggcagctacttgcaatgcttgtttattttcgctcataataaaatatcgtttttaacgtcctctaatgtgatacctaatacgtcgcaaaggatggcttcacgggcatacagaccgttttgcgcctgttggaaataatatgctttcgggttgttgtccacgtcgtaagcaatctcgttgacacggggcagcgggtgcagaatgcggaggttcggacgggtgttctccagcatcttgttgcgcaggatatatacatttttcactcgttcgtattccatcaggtcggtgaagcgttcgcgttgcacacgggtcatgtacaggatgtcggcatcagcgataatttcttcggtaaattcggtatgttcaatgtatttgatctgatgctctttgcagtatagcttatattcttccggcattttcagttcatcgggggcgatgaagtggaatgtaggattgaagtgacgcatagccatcagtagtgagtggacggtgcgtccgtatttcaagtctcccaccagaaagatgttcaggttttccagtgttccctgagttttgtagatggagtagaggtcgagcatcgtttgtgacgggtgctggttggctccgtctcctgcattgacgatgggtacgggtgctacttcgctggcatatcgggcagctccttcgagatagtgtcgcatgacgataatatccgcatagctgctaaccatcatgatcgtgtctttgagtgtttctccttttgaggagctggttgctttcggatcagtaaatccgatgacgcgtgcgccgaggcgattggctgctgtttcgaaactcaaacgggtacgggtggaaggttcgaagaacagggttgctactaccttaccttgcaataaccggcggttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtaaaggtacgaagaaaatgtaaaatacaaactttttttctctttttattcgtttttcggttggttttaaaatatcaaataaatcaaaaactcgtttgctgtatgctatattttatctacctttgcggcttagttataagcatcttttttaagctagaagaaacatgattcgaaaaataataaacgctctttgggtattgttggcagttgctttaatagctatcgtagttgtttttgtgtctatctctaagggctggataggctatatgcctcctgtggaagaactggaaaatcccaattataaatttgcaactgaggtattctcggaagacgggaaagtactgggtaccttctcaatggaaaaaaataatcgtgtatacagcagctatgccgatctttctcccaacatcattcatgcgctgattgcgacggaggatgttcgctttgccgaacattccggtattgatgcgaaggcacttttccgtgccatcgtcaagcgtggattattgttgcagaaaagtgcgggtggaggtagtacgatctcacaacagctggcaaaacagttgtttacggaaaaggtggcaagcaatactatgcagcgtctgttgcagaaaccgatcgaatgggtgattgccgtaaaactggaacgttactatacgaaagaagagattctgacaatgtatcttaataagttcgacttcctgaataatgctgtcggtataaagacagccgcgtctacttatttcggctgtgaacccaaagatttgaaaatagagcaggcagcgatgttggtgggaatgtgtcagaatccgtcccgttataatccggtatcccgaaatccgaaaatccgtgagaatgcattgggacgtcgtaacgtcgtactgcgtcagatggaaaaagccggttacatctcggatgcggaatgtgattctttgcaggcacttccgctgaaacttgcatatacccgtgtagaccataaagaaggtctggcaacctatttccgcgaatatcttcgtggtgtgatgactgccaagaaaccggttaagagcgagtaccgcggctggcagatgcagaagtattatgaagattcactttcatgggaaacaaatccgctgtacggctggtgcgccaaaaataaaaagaaagacggctcgaattataatatctacacggatggtctgaagatttataccaccatcaattcgcatatgcagcaatacgctgaggatgctatcaaagaacatttaggcgacttcttgcaacctctgttctttaaagaaaaacaaggaagtaagaacgccccgtatgcaagggcattgccgcaggcgcgggtggaagaattgctgaccagagccatgaaacaaaccgaacgttataatgtaatgaagtcagcgggtgcttctgaacaggagattcgcaaagcattcgatactcctcaggaaatgtctgttttcacctgggcaggtgagaaggatacgattatgactccgatggactctattcgctattacaaacacttcctgcgtacaggattcatgtcgatggacccgatgaccggatatgtgaaggcgtatgttggaggaccgaattatacatatttccaatatgacatggcaatggtgggacgccgtcaggtaggttctactatcaagccgtatctgtatacactggcgatggagaacggattttcaccttgtgatcaggtgcgtcatgtagaacaaacgctgattaccgaaacaggagaggcatggactccccgaaacgccaataataaacgttatggtgaaatggtgactctgaaatggggactggccaattcggataactggatttcggcttacctgatgggtaaactgaatccttataaccttgtaaggctgattcatagttttggtgtacgaaacaaggcgatcgaccctgttgtttcactttgtttgggtccctgcgaaatttctgtcggtgaaatggtaagcgcatatacagcttttgccaataaggggattcgggtagctccgttattcgtcacccgcattgaagatagtgacggcaatgtgctttctacgtttgcaccgcagatggaagaagttatcagtgtttcgagcgcatacaagatgttggtaatgcttcgttccgttatcaatgaaggaacaggcggacgtgttcgccgttacggaattacggccgatatgggcggtaaaacaggtacgaccaatgataactcggatagctggtttatgggctttactccatcattggtgtccggttgctgggtaggaggtgatgaacgtgacatccactttggtacaatgacttatggacaaggggctgccgccgcattgcctatctgggcaacttatatgaagaaagtctacgatgacccgactttgggatacagccagacggaaacgtttaaactgcccgaaggttttgacccttgtgccggttcggaaacaccggacggagaagtcttcgaagaaacgggactggacgatttgtttaattaaacctctcatcgtgcataaatgtatcatttgtatcggaagtaactacaaccggaaagagaatcttcttctggctcgcaggagactggtggatttgtttcctaccatccgctttacgtctgaacaggagacacgccctttgtttttcagaagtccggcattgttctccaatcaggtggcgatgttcttctcggaagcggaggaggaaagagtgcgcaaggagctgaaagctatcgagcagtccgccgggcgtcgtccggaggataagaaggaagaaaaagtcagtctggatattgatttgctctctttcgatgaccgggtgttgaagccggaagacctgaaaagagagtatgttgtgaaaggattagaagaattaaaatacaatcagatatgaaatttctgggaataatacctgcccgctacgcatccacccgtttccctgcgaaaccattggctatgctgggggggaagacggtgatacagcgtgtatacgaacaagtagcgggcatcttggatgatgcttatgtggctaccgatgacgaacgtattgaagctgccgtaaaagcattcggaggaaaagttgtcatgacttccattgatcataaaagtggtaccgaccgctgctatgaggcgtgcacaaagatcgggggcgactttgatgtggtagtcaatatacagggggacgaacctttcatccagccttcccagctgaatgctgtaaaggcttgtttcgaagaccctaccacgcagattgctacgttggtgaagcctttcacagccgatgaaccgtttgccgtactggagaatgtcaactccccgaaagtggtgctcaacaagaattggaacgcactttatttcagccgttccatcataccttttcagcgcaatgccgataaggaagactggctgaagggacatacctattacaaacatatcggtctgtacgcttatcgcacggaagtattgaaggagatcaccgctctaccgcaatcctctctggagttggcagaatcactcgaacagttgcgctggctggagaatggatataaaataaaggtaggcatcagtgacgtggaaacgatcggtatcgacacaccgcaggatctgaaacatgcagaagaatttttgaagaacagaagctgatttatggatcgtacgatacaacctgaaatacaagccctgaaaaatttccatatcctttctcccgtccggactactttgccgaacggtgtcccgttgacggttgtcaatgccggtgaacaggaggtggtccgtatggatattctttttgccggagggcgctggcaacagtcgcagaagttgcaggcgctgtttacaaaccggatgctacgcgaaggcacgcagaagtatacggcggcaaccattgcagagaaactggattattatggttcatggctcgaactgtccagttcgtcggagtatgcttatatcactgtctactcgttgaacaagtatctggcaaaaacgctggaagtcgtggaatccatgattaaggaacctgtgtttccggagaaagaactgcataccatcctggatacgaatatccagcaatatctggtcaatacttctaaagtagacttccttgcacaccgtggcctgttacaggcgctttacgggacacagcatccatgcgggcaaattgtagtggaggaggattatcatgccattacaccggaagtactccgtgatttctacggacggcattatcattcgggcaactgttccattttcctgtcgggtaaggtgacggaagatatcattcgccgggtgaccggtgctttcgggactcctttcggacaatatcagctgaaagcatcaaaaccgatattttcattcgttgccgttcccgaaaaacgaatattcatagagcgtgaagacgctttgcaaagtgcggtgaagatgggatgtaccaccattacccgtcagaatcctgactatctgaaattacgcgtactgatgacgctgttcggaggatactttggcagccgtctgatgtctaatatccgtgaagagaaaggatatacttatgggatttctgccggaattatgttctatccggatagcggtttgctgggaatctcgaccgaaacggataatgaatacgtggaaccgctgatacaggaagtatataatgagatagacaaactacaccgggagcctgttcctatggaagaactgacgatggtgcgcaactatatgctgggcgaaatgtgccggagctatgaatcgcctttctcgctggcggatgcgtggatttttattgctacttcggggctggatgaccagtatttctcccgttctttgcaggctgtaaatgaggtgacacctcaggaaatacaggaattggcacagcgctatttgtgcaaagagacattaaaagaggtcattgctggtaaaaagttgtcataatttgctttccggtatggcactttttgggagagaagttgtatctttgtccaaactgtaattttaatgagtaacgagtaaaactaatgaggaaatatctatatactacactttttttgactcttcttgcacagggaggagtgatggcacaagataacaataccagcaaaggtgggttcttcggaaagttgaaagacacattctctacagaaataaaaatcggaaattatactttcaaagatggtagcgtctatacaggagagatgaaaggacgcaaaccgaacggaaaagggaaaacggtctttaaaaatggggatgtctacgaaggggaatatatcaaaggaaaacgtgaaggctacggaatctattcttttccggatggagagaagtacgaaggtcagtggttccaggatcagcaacacggaaaaggaatctattattttatgaataataaccgttatgacggaatgtggttccaggattatcagcatggtgccggaacgatgtattatcataatggcgacttatacgtgggcaactgggcgaacgacaagcgtgaaggcgaaggtacttatacgtgggcgaacggtgctaaatacagcggtcactggaagaatgacaagaagaacggcaaaggtaccatgaactgggacgatggctgcaagtacgacggtgactggaaagatgatgtacgtcacggaaaaggcgtattcgaatataccaacggagacaagtatgacggtgactgggcagatgatatccagcatggaaaaggtacttattttttccatacgggagatcgctacgaaggttcttatcttttgggagaacgtaccggagaaggcgtttactatcatgccaatggagataaatatgtaggaaatttcaaagacggtatgcaggatggaaaaggtaccttcacgtgggcaaacggtgctgtgtatgaaggtgactggaaaaacaataaacgcgaaggcaaaggtatctataaatggagtaacggggatgtttacgaaggagactggaaaaataatcgtcctcacggtcagggctctctgaaaaccgttgccggtatgcaatataaaggtggtttcgtagacggactggaagacggacaaggcgttcagatcgacaaagacggtaaccgcttcgaaggcttcttcaaacaaggaaagaaagatggcccttttgtggaaacagataaagacggaaaggtgatcaaaaaaggaacctataaaatgggaagacttctttaaaagaaagaattatagataaataagaaagccggctaaattcaagtttagccggctttctttatcttatcctttactcatcattcttcatttagatgatatattgtgaactgatggactcgttattcattacccgcttgattgtttctgcaaacatatcagcgatgctcagttgtttcactttcgcgcatttcttagcgtaagggatactgtctgtaaataccatttcagtcaatccggattcctgcacacggaaagaagcagggtcagacattacacagtggctggcaatagcgcgtacggatttggctccggcttccatcatgatattggcagctttggtgatggtgcctgctgtatctacgatgtcatcgatcaatactacgtttttgtctttcacatcaccgatgatttgcatggaagctacttcattggctttttcacgtgacttgttgcagagtaccaaaggtacaccaaggtatttggagaaagtgctggcgcgttttgaaccacctacgtccggtgtagcaatcaccaggtcttccagtttcaatgactggatataggggaggaatacggctgatgcatacaggtgatctacggggatattgaagaatccctgaatctggtctgcatgcaaatccatggtaatcagtcggtcgatacctgctactgaaagcaggtcggctaccaatttagctccgatagatacacgaggtttgtcttttctgtcctgacgtgcccatccgaaataggggataacagctacgacgctctttgcagatgcacgtttggcggcgtcgatcatcaggagaagttccattaagttgtctgagttagggaaagtagactgcacaaggaatacatgtgcgccacgaattgattcttcgtaagaaacggcaaactcaccatctgcaaagtgggtgatgttcatgtttcccagaggacaattgagacttgcgcagattttctctgcaagatatctcgagttagttcccgagaataccataaagggtgctttttcgctcattttgtaatagatgttacctatttgttaatttgcctgcaaaggtaggaatttctcttattatttagaaagacttattgtagaaaaaataattttctctccaacttatcggaaatatttgtagatttgcaagtaagaacgaagaactgagaatgaagaatgaagaattatggacgaaaaacagaaaatgaagagcgaagaatgaaagatagttatcgcctgtctttttattctccattttccattttccattctccattatatataataggagtattgttgctttcctcccttttttcgtgtaccgacatggtgcccacaaaagaagtgaggcttatcgactcgctgaatggaaaagcgtatgcttatcgttaccgtaatctggactcttcctacaaatacgcctataaagcatatcggcaagtaaacctatataagtcggggaaagcggaagcttccaataatctggggttctgtgctttcatgaatatggatttcgaccgtgccgaggcgtatcataaagaggtatacaagctgactaaaaatgagcttgaactgttgatagcagacatcggactgatgaaaatctgccagcggacagcgctcaacaaagaattttatgattaccggaacagtgccctccgacggatgaagcgtatccgtgaagagagcgacctctttgccgaccgtcacgaagcgcttcggctggattacgcatttaccgaattttttctcgtttcctccatttactattactatctccagcaacggcaggaagcgataacctctatcgataatattcaggaagacgaagcgttgagcgataccaatcagcttctttattatcattatctcaaaggatcggcttctttggtcgcagcgaatactccggaagaacggaaactccgcgagtttgacgaactttatttcacttggcggacagccgtgaagagcaagcatccgtattttgaggggaatggaatgcagggacttgccaatctgatggcatccccgtctaattttgagtttttcaagacaaggcgtacacatgcgttggatcagtttgattttccggtagattctttgttccctttgcgtttggcccaactggcactggagaaatttcgcgaatataatgacttgtatcagattgccggagcttatgtatctatcggcaaatacctgaatgcgcatggacgttatcaggaagctttggatacattatcaaaagcattgaactgcgtaaaccatcatcacatgctttattatcataatgaagtggatacgcttgataaattatatacgtttgccgagggagatactacttataccggagttccatggattggacaggagaaggtgaagaccgttcccgaatggatctcacggataagggagcagttaagcgtttcatatgccgggctggggatgaaggatgcttctgattataaccggaatatctatctggatattttgaactttacccgtcaggataaggagttggaaagccgttatttgtctttggaagcaggttcgcgacagatgacggtcgttctttttctggttattgtcggcttggtactggtgattatcctttggtggttcttcaacaaacgttccaaaatcaggaatcaggtggatgtggagcgtctgcaacggattctctctctttgtcgggatatcacttcttccataccgatgaacgtacctctgattcagcaaggcattgaccagttgttcgggaaaggacgtctgacgctggaaattccggaagaaggaaaagctgcactggtaccttcttcccatcgactgaaccgggacgagaaggcattggtgcatgtagtggaaccttatatcgtatgggctgctgaaaatgaacaaatggtggctacgttgagcgacgagcgaaatcagctggagaaacagcggtatatctacgagcagcatattgcaggaaacaaacgtcagaatctgataaagaaggcttgtatggccatcgtcaacgggattaatccttatatcgaccggattctgaacgaagtacataagttgacggaaaaaggatatattgatgacaccaagataaagaaagagaagtaccagtacattgatgaactggtgactaccatcaacgaatacaatgatattctggcactttggatcaagatgaagcaaggtacgcttagtctgaacattgagacattcagtctgaatgaattgtttgatttgctgggaaaaggacggcgtgcttttgaaatgaaaaagcaaaagctggaaatcgaaccgaccaccctgatggtaaaggccgatcgtgcattgaccttgtttatgattaatacactggctgaaaatgcccgtaagtatacgcctgaggggggaacggttaaagtatatgcgcatgctaccgatgcgtatgtggaaatctccgtagaagataatgggagaggactttcagcagaagatatcgcgcatatcattggtgaaaaggtatatgattcgcgtgctatcggcatgaaagacgcggcagatccggaagaactgaaagagaataagggaagcggttttggcttgatgaactgcaagggaatcatagagaaatataagaaaacgaatgaactgttccgggtatgcgtattcgatatagaaagcgaaccgggaaagggaagccgtttttatttccgcttgccttcaggagtacgtaaagtgattggcgtgttgctctgcctgttgcttccgttgggaatggcttcttgtctgcatgaaccccttccgtcgatattgcaggatagtgactccattgcgattactacagattctacttatgaagatctgcttgatgcagcctctgattatgccaatgccgcttattttgccaatgtggatgagaactacgaaatagcattgcagtatatagattcggcaatgatgtcgctgaatgagcattataagaaatatacgcgtaccccgaagccgcatcgatacatgaaactggtgggaaaaggaacccctgccgaactgttttggtggaatgaactttttgattcagactatcatgtgattttggatatcagaaatgaagcggcggtagcattccttgctttgaaacaaattgatgcctacagttataataattctgcttttacagatttatataaggtacagggagaagaccagactttggaagggtattgcaggcagttggaacgatccaacacgaataagacggttggtatcatcctctgtttcgtcttgctgatcgtttctctgatcggctattatctcttgtatatgaggaagatgttgcagaaccgtctgaacctggaacaggtgcttgagataaatcagaaagtttttgccgcctctttggtcagacctcagactcaggagaacgaggaagcgcttcagagagaggaaaatacacttaaagagattccgcagcgcatcgtgaatgaggcttttggctcagtaaatgagttgttgacaatcagcctgatgggcattgctgtttataacgaaaccacgcatcggctggaatatgcttcctgtcccgggcaggaaatgccggaaatggtgcagcaatgttttgaaacaggggaatatctctcagaacagaatttgcaggcgattccgttgatggtggaagccggaggtgagcatcaatgtgtaggtgtgctttatctggaacggagggaaggaacgcaacaggaaacggatcatcttctttttgagctggtagcacgttatgtatcgattgtggtgttcaatgcagtggtaaagcttgccacgcaataccgggatatcgagtcggcacacgaggaaacacgccgtgcttcgtgggaagacagtatgcttcatgtgcagaacatggtgcttgataactgcctttcaacgattaaacatgagacaatttattatccgaacaagattaaacagattattggtcggttgaatacgcagaaccttccggaaaaggatgaacgggaagctgtggaaacgattacagaactgatagaatattataaagggatctttacgattctgagttcatgcgctgcccgacagctggaggaggttactttccgccggaatacgattccggtacaggagctttttgatgctgctggaaaatacttcaggaaggtcacgaaaaatcggacggaaaaggtagaactaatcatagaaccgatggacgccaaagtgatcggtgacgtgaatcagttgcgtttcctgtttgagaatctgattgatgaagcattggcggttcgtgaagaaggagtgatacgcttgcaggctcgtaaggataacgaatatatccgtttcctttttacggataccagacgcgagaagagtgtgacggagctgaaccagttgttctatccgaatttggctcgtatgacttccggtgaaaaaggagaattgcgtggaacggaatatctgatatgcaagcagataatccgtgaccatgatgaatttgcggggcgcaggggatgccgtatcaatgccgaaccggcagaagggggaggatttacggtttacttcaccatcccacgcagataaagaagaagacacataaaagttattagataaataaaatggaagaacagaagtttaaagttattattgtagaggacgtaaaactggaattgaaaggcacagaagaaattttccgtcatgagatacccaacgcagaagtgatcggcacggcaatgacagaaagcgagttctggccgttgatggaagcacagcttcccgatctggttttgctggatttgggactgggaggttctacgacgattggcgttgatatctgccggaatattttcaaacgttataagggggttcgtgtattgatctttacgggggaaatactgaatgaaaaactgtgggtggatgtgctgaatgcaggagcggatggcattattctcaaaacaggagaattgctgaccaagacagacgtacaagctgtgatggacggcaagaagctggtattcaactatccgattctggagaagatcgtagatcgtttcaaaaagtcggtagcgaatgatgccaagcgtcaggaagcggtaatcaactatgatattgatgaatatgacgagcgttttcttcgccatctggcattaggctacaccaaagatatgattgccaacctgaaagggatgccatttggcgtgaaatcactggagaaacgacagaatgacctgatcggacgtctcttcccgaatggagaacgggtgggagtgaacgcgacccgtctggctgtccgtgcattggaattgcgcattatcgatctggataatctggaagctgatgaagagtaaatggcgtatgccgcatcccgctacgatgttcctgctgctgacaatggcggtggtctttctttcgtggatatgtgatatctacggactgaaagtaacgctgccgcaatcaggggaggatattcgggtgcaaagcctgctgagtcctgagggaattcgctggtggttgcggaatgctatcaagaattttaccggttttgctccgcttggcatggtgattatcgccatgttcggactgggtgtggcccaacattccggatttatcgatgcgtgcatccgtctgggagtgggaaaccggaaagagaaaagaaaagttatcctgtgggtgattgtcctcggattgctgtcgaacgtcattggtgacggcggttatattattctgcttcccattgccgccatgctgtttcagtgggtgggacttcatccgatagcggggattgtgacggcttacgtttccgtggcctgcggatatagtgccaatatcgtactgagtacgatggacccgctcttggcgcataccactcaggaagccgcgctcacactgatgggatatcagggaaacacggagccgctgtgcaactacttctttatgagcgcttcgacagtggtaattacagggatcgtttattgggtgactcagaaatggcttctcccgaacttaggaaaatatgagggaagtgtgaaagtcgaagcctaccgccctttgtcacggaaagaacgtcgtgcgctgatggtggctgtcgtagtggcagggatatacgttgcccttattttgtggcttactttctcttcctatggtatcctgcgtggcgttaacggaggtttgatgcattcgcccttcattgccggtatcctgtttctgctatctctgggcgcaggctttacggggatggcttatgggttcagttccggtcgttatcgcagcgataatgatgtgatcgaaggacttacccagccgatcaaactgctgggtgtgtatttcgttattgctttttttgctgcccagatgtttgcctgtttcgagtattctcatttggacaagtgtcttgcgattatgggagcggacctgctttcttcttttgagccggctcctttgtccgcactcatcttgtttatcctgtttacggcatttatcaatctgattatggtatccgccacttccaaatgggcatttatgtctttcatcttcatcccgatgtttgcgcagatggggatttcgccggacgtcacgcagtgtgcttttcgtatcggagacagttcgacgaatgccattactcctttcttattctatatgccgctggtgttgacgtatatgcggcaatatgacaaacagatcacatacggatcgttgctgaaatatacatggaggtactccttgtgcattctggcagcatggacattgctgtttatcgtatggtatctgttgaagataccgatggggttataattcacgattcaaagttccggttttaataaccggaattttgagtttctgaattaatcgctatatttgcacccgtcccttaaagaaaaagaacgaatgaatttaccagaagtctctgaaaaactaatcgaacaactgaatcacggtagcaccaaagcatttgataaaatttatcatacgtactatttatacctgtgtgcgatagctgtttactatgtacatgacaagagagtcgccggtgaaatagtcaatgatgtcttcgtctctttctggcagaatcgccaccatatcacttatcctgcccttccgtatcttcgtcgggctatacagaatgcaagtatcagttatttgcggtcttccgcttttaatgagcgcataatgaccgaacagatggaggaaatatgggcttttctagaaaatcatattctttcttccgacaatccattgcaggcattggaaagcagtgaaatgaacgagatcattctgcggaaagtagaggaactccctgccaaatgccgtgctgtttttaaggcgagcctgtatgaaggcaaatcgtacagcgaaattgcggaagagcagaatattaatgtcgccaccgtcagggtgcagatgaaaattgcgctgactaaattgcgcgaatcccttggtactccctatatgatagctattttgatgtttctttaaaaaaaacggttttcttttaaacgtttctttttttattgcgtatctagttatatacaccatagaaaaagaacggtttatgatagaatattacgataaagaagaactggaattacagattagtaattatttgtcgggcaatagtaccgatgaagaaaaagaaacgttgcttgcctttctggcttccaatgaagcagctgcccggactttccgggaaatgtctgccgtatgggcactttcttccgtaccgtcgtttgcagaaatagaaaactccaatttagtgcggataaaggagagaatgactgctcctgcctcttcgaagcctgtccggaaactgatacctgtctggctgaaagtggctgccgccgttattctgctgatcggctgcaactatttctggtatacgtatacggaaaatctgacggaagtatataccaacgccgattctccttacgaaatcaaggttcctgccggatcaagaacgaatatcgttcttcctgacgggacggaggtttctctgaatgcaggttctgtattgcgctatcaccgtgggtttggtatccgcgaacgtaatgtgacgttggatggcgaaggatactttaaagttgcgaaaaatgcagaggttcccttcttcgtgaagacgaacgatgtgcaggtgcaggtagtcggcacggtattcaatgtccgtgcttatgatgacgataattatgtgatggtgtctctgctggaaggcagggtgaatttatcggcgtctgctaattctgtgatgaaattattcccgaatgagcaggcactgtataacaagaacaccggacgaatggaaaagctgaagaccaatgcaagtaaagcctgcgattggctggatggcgggttgaccttcgagaatgcttcattcgctgatattgcccatcgtctggaacgtaaattccaggtgaagatcagcatagaaagcgaacgtctgaaggccgaacacttctccggttctttcgacagcaatcagaatatttatgatatattacacgaaatcaacgttgagaaacaatacacgtggaaagtcagtggtgacaccatctttattaccgataaaagaaagggggtaagataaaaggaaggagaaagaaaatggacacagccgatagatataccggcagtccgcagctacgataaataactatatgttaacctttaatagtgataaaaatgagattgataataagaaaaacattattgatgtttctgcttttgtccctaagtaatgtcctgacaggttttcaactttcagcacaggaacaaaacaagaagttcagtgtcaaagcagataacgttactttgaaagaagccattgaagtagtcaggaagcagggaaattattcttttctgattcgcaataacgacattgacctgaataagaaagtctctgtgaacgtggacaagggtacaattaatgacgtgatggcccaactgctgactggtacggggatcagttatgaagtgaacggaaaccgggtggtcatattccatgccgcagtgcctgaaaaggaacagggaaaagcgtttgtcctgaaaggcaaagtgaccgatccttcgggtgaaggagtgattggtgccaatgtgaaagtgctgaattctacggaaggtacgattacggatatggatggaaacttttctctgtcggtgactccgaatgcacgattatccgtgtcttatatcggatatgctacgcaggaagtcgttgtcaaaaatcagactcctttgcacattgctctgaaagaagacagccgtctgattgacgaagtggtggtagtaggctacggtgtacagaagaaagcgaatctgaccggtgcggtaagcagtgtgaagatggatgaagtattgggagaccgtccggtagtgtcggtcagcgatgccttgaaaggtgcgatgcccggtttgcagattacgggtaactccggtaggccgggagaggaaatgagtttcaatatccgtggtgtcaacagtctggataagaatggcaaaccgttggttctggtggataacgtagaaatggatatcaatatgctcgatccgaatgatattgaatcagtaacggtcttgaaagatgctgcttcttcggctatctacggggcacgtgccgcatttggcgtcattctgattacgacaaagaaaggatcggattcaaccaggctttctattaattattctaacaatttctcatttagcagacctgccaatatgcctcgtaaggcaacaccgcttcagacggtgcaggcttataaagacatgggaaccatcaactatcagagtggacagaatgtggatacgtggctggatttattgaaagaatacaatgccaatccttcggcttatcccgatgggtatgcaatggtggacggattgcgctatagtctggcagaaaccaatctgtttgatgatatgatggagaccggtttccagcagacgcacaatctttctgtaggtggcggcacgaaagatatatcttatcgtttctctttcggtatggtcgatgagaatggagtgctggcctcggacaaggatgcgtataaacgttacaatgtgtcttcttatatccgttcggacgtattctcatggattactccggaactggatatcaaatacacgaactcgaaatcagaattgccggagacttcgggaggatatggaatctggggagcagccgttgccttcccgtcttatttccctatcggaacaatgaatatcgacggagaagaactaccgatcaatactccccggaatctgattaatcttgcttatccgacgactatccagaaaaacaatatccgtatcttcggaaaggtgacgattactcctttgaagaacgtcaaactggtgggtgaatatacatacaaccatctgagtaatgaaaagaccaagtttgaaaagaagttctattatgcccacggaggtaactttgtgaaagagacttcgacggcaaactctaagtatgaaaactccaacggcattaccgattataatgccttgaacttctacggaaactacaataacacatggggcaagcatgaagtcaccgtgatgggaggtttcaatcaggagagcagtgactatcgctatgcggaaatgtcgcgtatgaacatgattaacgaagaccttccttctatatcgcaggctacaggagattatttcgctaaagataaattcgaacgctatacagtaagaggattattctatcgtatcaactactcctttgccggcaaatatctgattgaaacgaacggacgctatgacggctcttccaaatttccgaaagacagtcgcttcggtttctttccttctgtctctgccggatggcgtgtgagcgaagaagcgtttatgaaaccgttgacatccgtattgtctaacttaaaattgcgtgcttcgtggggtaatatcggcaatcagagtatcactccatacgcttatattccgggtatggatgccgagcaggcttactggaccgtttcgggtatcaaggtaactacccttaaaccagctgcattggtcagtaacagttttacctgggaaaaagtgacgactgtcgatgtcggttttgatctgggtttattgaacaacaggctgaatcttgtattcgactggtatcgtcgtgatacgaaaggtatgctcgctccgggagcggaattaccggctgtgctgggtgcaagtgctcctttgcagaatactgccgatcttcgttccaaaggatgggagatcactgtagactggaatgatcagatcggaaaagtgaaatacaatctgggcttcaacctttatgatgctaaaaccaagattaccaagtataataacgagacaggtctcttcggcaaggataagaacgataaagatacttaccgtgtaggtatggaactgggtgaaatctgggggtatgttaccgaccgcctgtatactgttgatgattttgatgccgatggcaagctgaaagcaggcattccaaaagtggaaggctacaatccgaatccgggtgatatcctgtataaagatctggatgacaacgatattatcaacggaggtacaagtacgacgaaagatccgggcgaccgtaagatcatcggtaatagtacccgtcgttatcagtatggcatccacggtggtgcaaactggaagggggtctctttatctttcctgttgcagggagtaggcaaacgtgatttgtggattatgaatgacttgttctatccgcactatgacgcatggacgacggtatatgacacacaactgaattactggacgccggagcgcacagacagctatttcccccgtctgtatgagaaagctgccggaaatacagctgccaatacacgtattcagacccgttatctgcaggatggttcctacctgagtatccggaacatcaccttatcttataatttcccgtccaagtggatgactaagatcggtgtcaataatctggctgtcttctttagcggtgagaatctttatacattcgatcatttgccgaaaggactcgatccggaacgttcggtaacggatgacttgggacaacgcggttttacctatccgtatatgcggcagtattcgtttggtatcaacctttcattctgattgtttcactatttaaaagagtaattgttatgaagaaatatatactgggtacgggcattagtctctgtttgctgatgtcgtcttgtttgaatgactcttttctggaagtttatccgaaaggacaacagacggaagcgacagtctttactacctatgataacttcaaaacgtatgcatggggattatataatgtattcttcggatatacgtatgatacggggcagacggacgaaatattccgcggagattttgagtcggacaatatgatcaaaggtttgtccggatatgaagggcagtgggcataccagaaggcgaaggcaacagatgaagtcaaggaatgggattacgactatatccgccgggtaaatctgatgctggacaatatcgatggttcgcagatgaatgatacggagaaggagcactggcgcagtgtcggctatttcttccgttcatataaatactttcagatgctttcccgctttggagatatcccttgggtggagaatgcgttgaaagaagacagtccggaactgtacggcaaacgggatagtcgcgatctggtggcttcgaatatcctgtccaacctgaaatatgcggagacacatatcggtgcggacgatggcaaaaacaccattggtatatctgtggtgcaggcacttatttcccgttttgctttgttcgagggtacttggcggaaatatcatggattgtctgatgccgagacttacttgaaagaatgtgtacgtgcgtcggaagaagtcttgaaggtttatccgaatgtgcatccacggtatgacgagcttttcaattcggaatctttggatggggtaacgggcattatcttgtataaagcctatgaaaccggtcagttgatgcatggtctgacacgtatggtgcgtaccggtgaatcttatattgaggcgacaaaggatgcggtagacagttatctgtgtacggatggtcgtccggtaagtactaccaccagtcggtatggcggtgataaggagatttatggacagttccgcgaccgtgattaccggttgtatctgacgatatgtcctccctatatggtaaagaaagaaaatggtccgagcacggccgactggaaatatacggatcatgcgcaggacagagagtttatagatcttcttgctacaatctccggtgagacttatcatcgtttgccgtcttccaacttcaaaggattcacggtgcaggggcagccgcacttcaagaatcagaactggggacagggctggaatgcttctcaaatgggattctgggtatggaagtactataatacgcataccgtagctaccaatgccaacggagtgaatacgacagatgcgcctttgttccgtgtaggagaggtaatggtgaattatgccgaagccatgtgcgaattaggtaagtttgatcagacggctgccgataaatccattaataaacttcgtgcacgcggacatgtagcgaaaatgacggtcgaagacattacagatgattttgatacgacccgtgatccttccgttcctgctcttctgtgggaggtacgcagggagagacgtgtggaactgatgggggaaggattccgtctggatgaccttcgcagatggaaaaaaggagactatgtcaataaacgcccgttgggagtatatgtgacgggagcttcggctaaaaatctgaaagtaaccggcggaccgagtaatgacgaagggtatgtttacttctttgacgctccgctcggatggcaggaacattattacctgtatccgctgcctctgaagcaactggcactgaatacgaatctggaacagaatccggtatggactaaataattttttgagtaaaaacagaggcaagacctgtaatattttgtatattgcaggtcttgaaaatttaaactataaaatgaagaacgctatttcggtaaaatatacccttctttgcgggacagcttgctgtatggcctctgctgtgcaggcgcagcacaatgtctccgatgtttccagaatgaatgttctttttctgatggctgacgatatgcgtcccgaactgggttgttacggagtggaggcggtcaagactccgaatatggatcgtctggcatcgagcggagtcttgtttcagaacgcttattgcaatgttccggtgagtggcgcttcccgtgccagccttctgacaggcgtatatcctcactatcccgatcgttttgtgaatttctcggcttatgccagcaaggattgtccggaggctatacctctttccggatggttcacaaagaatggttatcatacagtttcggatggcaaagtttttcaccacatgagcgatcatgccgcatcgtggagcgaacctccctaccggaatcatccggatggatacgatgtctattgggcggaatataataaatgggaactttggatgaactcagaatcgggcaagacgatcaatcccaagactatgcgcggaccgttttgcgagtcagcggatgttccggatacggcatacgatgacggaaaattggcggaacgtgccattcgtgacctgcggcgtatgaaagaaatgaacaagccgtttttcctggcttgcggattttggaaacctcatttgccgtttaatgctccgaagaaatattgggatttgtataagcgggaagagatacctttggcttccaaccgtttcagaccggaaggcttgccggaacaagtccgtaattcgagtgagatatatgcttatgcacgggtgactgatacgggggatgccgattttcagcgggaagtgaagcatggatattatgcttgcctgagctacgtggatgcacaaatcggaaaagtgctggatgctctggatgagttaggtctggcggagaatacgattgtggtactgctaggagatcatggctggaatctgggcgaacatgattttgtgggtaaacataatctgatggaccgttctactcatgtgccgttgattatccgtgtgcccggaatgaaaaaaggaaagacccggtcgatggttgagtttgtagatttgtatcctactttgtgcgagttatgccagataccacaaccagcagaacagttggatggacagagctttgcaaaagttttcagcaatctgaaggctaagacgaaggatgaagtctatattcagtgggaagggggagacaatgcggttgatcaacgttttagttatgccgaatggatgaaaggtgacgtgaagaaagcaagtatgctgttcgatcatcggatagataaagaagaaaacaaaaatagagtcaatgagaaaaaatataagagtaaagttgaatcactctcttcttttatcaaagtgaagaaatcatcattaaaaaaataatatgagaacaccaattatgtcatgctgccgtttgatggcagttgctttatttctgttttgcagtatgccgctatttgctcagcggcaggatattttattaaacgacaactggaagttccgattctcgcatcaggtgcagaaagggtcggaaataagagtagatctgccccatacctggaatacacaggatgctttgtccggaaagatcgactataaacggggaatcggtaattatgaaaagaaactgttcattcgtcccgaatggcaaggcaagcgtcttttccttcgtttcgaaggggcgaacagtatagcagatgtatttatcaatcgccgtcatatcggtgaacatcgtggaggatacggagcttttgtctttgaaataaccggagaggtgaattatggaaaagagaactctatattagtgcgggtgaataatggagaacaactggacgtgatgcctttggtgggtgactttaatttttatggcggtatttacagggatgtgcatctgctgatcactgatgaggcatgtatttctcctttgaattatgcttctccgggagttcgtctgatacaggatagtgtcagtcatcaatatgcgaaaataagggcggtcgttgatttggcaaatggcaataatgccggtcaggaagtagaactgggtatccgtttgctggatggtcagaaagtggtggcgcaacagaaacagacacttactcttgccgggaatgcagctttgcagcaggaacttacatttgagataaataatcctcatctgtggaatggccgtcaggacccgtttctttatcaggcggaggtttctctgtcgagaggagggcagctggtagattgtgtgacgcagcctttaggatttcgttattatcggattgatccggataagggattctttttgaatggtaagcatctgcctcttcacggtgtttgccggcatcaggacaggagtgaggtgggtaatgctttacgtcctcagcatcatgaagaagatgcagccctgatgctggaaatgggagtgaatgcggttcggctggcacattatccgcaagctacctatttctatgatctgatggataagaatgggattattgtctgggcagaaataccttttatcggtcccggaggatatgatgataaaggatttgttaatctgccttctttccgtgctaatgggaaagaacagctgaaggagctgatccgccaacattttaatcatccttccatctgtgtatgggggctgttcaatgaactgcttgaattcggtgataatccggtggaatatatcaaggaattaaatgagctggcgcatcaggaagatactacccgccctaccacttcggcaagtaatcaaatgggtgacttgaatttcataacggatgccattgcatggaatcggtacgacggatggtatggaggcaccccggccgatttaggacgctggctggacggtatgcatagagatcatccggaaattcgtattgccattagtgagtatggtgccggtgccagcatttatcatcagcaggattcgttggtaaaatccgtgccaaacagttggtggcatccggagaactggcagacctattatcatatagagaactggaaagcgatttctgcccgtccttatatatggggtagctttgtatggaatatgtttgatttcggtgcggctcaccgtacggaaggtgatcgtccgggaattaatgataaggggctggttacctttgaccggaaagtacgtaaagacgcgttctacttttataaggctaactggaacaaggaagaacctgtgctttatctggccggaaaacgtaacaccgtacgttcccgacgtctgcaaacgattactgcattcactaatcagcccggggcggaactgtttgtcaatggaaaaagctatggtaaggcaatgccggatcagtatgctattttggaatggaaaaatgtggagttgcagccgggagagaatgaaataaaagtagtttctatcaataaaaaagtaaaattgatggatagttttcgctgcaaactatagcataatgcaatagaaagcattacctttgcggtctatgtgtaaagctaagaaggagtccgtgaagtaaataacctttggcagtctgtcaaggttatcccttaattcatactctggcatattcttgtcagagttattttcatattctatataataagtataatcgcatgtctataaggcggataataactatctgcaagatatacatgctcaaaaaaacaatgaaatgataaattcaattaatatacaaattagagagaccaatacagatgatttcgacagcataatgactgttgaaaaacaagcgtttggctatgacaaagaagcacagttggtagccgacctgctggctgacaaaaccgcagaaccaatggtttcgttgctcgctttctacaaaggtgaggctgtcggacacattctcttcaccagagcctattttgatggtcagggagcactacagatgatgcacattcttgcacctttagctgtcaagccggaatatcaacggcagggtataggcggaatgctgatacgggcaggcatagagaggttacaggaaaaaggttcgtgccttgtgtttgtattggggcataaagaatattatccagaatatggttttataccggatgcagccaggctgggttatcctgctccttacccgatactggaacagttctcggattattggatggttcaggcaatcagtccgaagggatttgatgtggataaaggaaagatcaggtgttcggatgagttgaacaaacctgaacattggagagatgatgaatcggacagatagttccctgatagtcgtttgttaaaatagaggaaatatataaagatttaggtagctttattagtgcagcctaaatataagacttatttttgtgtggggctgtccaaaatcggacagccccttttttagatgtattagtattttctattatctttcatcgccttcctccacctcttaaaagccctcatcaggctatcttccttcactgtaccttccatattataatgttccacaaaaagctctattgagcgtttgaacatgattccgtttttgaatttattctccagcagaaattcatagagttccgctctcatttccacttcgatttccttttctatggttaatgcggcggatataggtggatgaagagatatgcaataagcattgattgatgaactatattaaaatcgaaagttatatatggagatgagaaaaaagatcgtagtccggaggaacgattcagctatattattcgttgtgccaatgagcagtctggttgcggagtagtggtattggtggatgaatacgataaacctctgttgcaggctttgggtaattttatttatagaatatcgggtggatgccaacaatccgcttccattgatttatcagagaggttagctgattatcaaggactatgacaaagaatttcaactttatcgtttggctttccctaatgaagaggttcgttatggtttccttaatttttgggttccttattacacaccggtcaatgaagatgagaatttctatataggcaaattcgttcaggaatagcgtgtcggaaaggtacctgagcccgataaaaagaagtttggttgattgcgtcaacaattcttctatcggtctcaggttgttttatttaaaactgcttttcaatataaatacttcaaacgtttttaatagtatcaactggtgtctttccgaaatacttcttatatttttcgcggaagttatccatatctttcattccgattttctctgggacttcgtttacgcgatattttccactctttaacatttcatgcgctttttccattcggattttgagaatgaatttgttaagtgcttcgcctgttaattgcgtccacttgttgtaaagacttgtccggctaattccaagctctttggcaatggagtctatggttagtttttcattattcagattttccagaatgattttagtaactttacttatcaaagggtgtttaccatcctgcaatatttctgacgcttttgtctccaaaaactcttctccaaataatcgttgtaagaatgattttcgaagaaaacgagtgtttttgataaggattgacatttcaagctttaaatctgttacactaaagggctgttgcaagaatgtatcggctaaagaagtctttcttctattgtgctggttaatatctatatgcgaactataaagtatgataggtatgattgatgtttcgcaagatgttttcaatcttgatgagagttcgacaccatccatgttttgaagttctgtatcacaaatcactaaatcaggatattcattttttatgtaagccatcgcttcgatgccatctctaaaacttttaatagtaaactcttccgttaaacaacttgtcagataggatcggaaatcatcattactgtcggcaagtacgactgtcggcttgtgagaacttcttttacagggagcctttgaaagcaaacgatctatcttttcaatctcagtatgattggtgatactcaatgccgaatgatttaattggtttttacaagagcattttactggaaactttaatgtgacagtatgatatgtactgtttactatgatttttccattacacaaattcgttagtttcttatataatatgctttttgcaaaatcgcattcaaattctgttgtctgtctcatcaaccgatgtttattttgattataaagctttgtcagtttaccatctcctgaatcgggtacacttatttcccaatgttcctgactgatagaaatcagtaatgtaatgtttgtttttggtttggaacagtcgattgcattagttatgaatttatcgataattggtgagactttgcttttgtcaaaccatacactggcataggtgaagtttgtattgatgattagttttatgtgtttattcgttgcatagccttgtagggattgaattctgcttcttacatagcttcctaattcatgttcggtaatgtccatggcttcgggatgattatgcaaatatttcaatccggacaatctgtccagattctcatttaagcattctatattccgaatagctagtaataaatcattcttcatattctcgggacaggtgtcactacagatcgttcgtaaaggaacatggactaaggtaattggatttcgaatactttggaaagaatctataaaatactggttctcttctttgaggaaatttctttctttttgtatggaaagataatgaaataaatgccagtagagatagaaacttattacaatcaacaataaaactaagtatgattgattctcaaatattgttgctattaagaaagatgcagcaatagatattgtctttaaatacatcatgttgttatattttaaatcctttatagaatccctaaaaccatatctaaaaagaaaataaggcttccaacaaaatataatcaacaataaacttaaaattactccgcctataatcccatttaatccccaataataacccaataaaatagaacaacctatattaataccagcctccaaagctggtgcccatatatcctgatacattccaaaagcagcaataaaaagatcatgcacccttgtacaaacaataaaaacataaataagtagcaatataaaagtactttgaggcagtatatacttctcccccacccatagagaaacaaaagaattagttaacataaataaactaaaacaaagtatagatgcaaaccaataacgcacagcaaccatttcccaataaaaagactttattttcgctttatttccctctgctaccaaattacctattcccgcagacattccattaaaacatgaattaacaaataatgtaatcccaccaattatcaacatatagttaccatatatagccaccaacgttaatgaagcatatgcatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaagtttcccttttgatgggtaagtattcaaccaaaaatattctttttttataattacattgagagcacacgctataatgaatgaaaccaaaagctctataactaaccaataaacataaccatgcataagccacatgattgcgataatttgcaatatatatttcaaagttttaccaccttgtacacaatatgttactttatattctttttgatcagcaataagcacaatttggcgataattgataaaatagccaaataaagaacttactaatagtacaataaaagaagcatatgcataccacataggtaactccatctttttaaaaattaaaggaaaaaaaaagattaaaatacaagcacccaatatcataacataagcaactttacgataaagccatccctgcacagaaacaatttcattcaccatttgtctgtctttttcaaataaaggatgataaagagtataagatattgcagaacctatacctaattcagctatatttaaaaaacccaaaatattagtagctgttgtattaagtcctaatacctcaatacctagtcaaaacgtattcaaattagagtgattaataaatttcaatatcaaatttaaaatcaaagaatatgaattatccaaaagcgatacttctttcattggcgttattggctatgcattcgcttaatgcagaggtagtcacataccctgctggggtcggggtgaaaaccttaaacgatttttctgtggaagtgcgtcagggtagcggaccgtggttgcccgttgacgtttatcctgttaaagttgatagggttgatgaaaaaggtcataacgtagaggttgcctccattgcttatttcgattttgacggaatggtagatgtgcgagtaatcagcaacaaagagagagtcaatagtgtgagagtacgtcctttaagctataagataacaccggattgtgttggagacacagtgacattctcactttcgcgtcctcgcaatctctcagtagaggtcaatggagatatttttcacaatcttcatctttttgcgaatccgattgataaatttcgtccttccgataaagaaatccaaagggctctcaagaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggaaggagcacatgatgtgaatattttcgggagaggcgaggtacaccctgatggcaggggagccggtgtttgggtcagacgttctaaaaatgtcaggatcgacggaattgtggtttcgcaactccccataggacaatgcgattcggtagagttgacgaatgtgaaatcaatcagctattatggttggggcgacggaatggatgttttctcaagcagtaacgtgatattagatggggttttctgtcgtaatagtgatgactgtgccgcagtttatgcttctacgcaaggatttaaagggggaagcaataatgtattggtgaaaaatgcgacactttgggctgacgtggctcatccaatcaatatcggaggacatggagatccgaacggcatggatacagtgcagaacgtcacttttaggaatatcgacattcttgatcaggcagaaaaacagattgattatcagggatgtctggctataaatccaggcgacaatacattggtgcgtaatattacgttcgagaatattcggattgaagattttcgtaacggacagcttgtgaatttcagaatcagtttcaatccgaagtattgtgtctctactggcagaggtattcagaatgtgcttgttaaggatgttacttacaatggatcgggtgaaaacttgtcgatcattgcagggtatgatgagaatcacaagatatctggtatcaggtttgtgaatcttgtggtcaatgggcgaaagattacagacgacatgcctgggaagccgaaatggtataaaaccggagatatggccggtatctttgttggagaacatgtagaaaatctctcttttgaatagaaacgaagcagacagaatgttagaaatggcgccacatgccaaaaactgtcatgcggtcagaaggaaagattatacttcaatttttatcacaatatagataaaaattgaagttttttatctatgttgcagccgattttagaaaaagaagtttggaatgaacaataaatacgaagaacggctgggaacagaacgtatgttaccgcttgtttttaagatggcactcccggcagtggctgcacaatttgtcaatctgctttatagcattgtggaccgtatatacatcgggcatattccgggaattggcaccgatgcgctggcgggtgtaggggtgactacctctctcattatactgatttcttctttttcggcaattgtcggcggcggtggtgctccgttggctgccattgcactcggacagggcgaccgtgtacgagccggaaagatattgggaaacgggtttgttctgctgatattgtttactttgctgacttctgtcattgcatatacttttatggaacctattctcctctttacaggagcttcggaaaacaccttggaatatgcggttgactatctttccatttatctcttgggaacgatatttgtcgaaatatccaccgggttgaatagctttatcaatgctcagggacgtcctgccattgccatgttttcagttctgatcggagccttattgaacatcattcttgatcctatttttattttctggtttgacatgggcgtgaaaggtgctgctttggctacagtactttcccaagcatgcagtgcggtgtgggtggtaagtttcctcttttcccgacgtgcctctctgcctttggagaaacgatatatgggactggaccggaagattatcctttccatattagctttaggagtatcccccttcattatggcaagtacggaaagtctggttgggtttgtcctcaatagcagtctgaaggaatttggagatatctacatcagcgcattgacgattctgcaaagttcgatgcagtttgccagtgtaccgctgaccggatttgcgcaaggattcgttccgattataagttataacttcgggcatggtgacaagcagcgtgtgaaagattgcttccgtattgtgctggtaaccatgttttccttcaatttgatattgatgcttttcatgattctcttcccttcgacggttgcctctgctttcaccagtgatgaaagactgatagaaactgtacgttggacaatgcccgttttcttgggtggcatgaccattttcggcttgcaacgtgcctgtcagaatatgttcgttgcattggggcaggcccgaatctctatcttcattgctctgttgcgtaaagctatcctgttgattccgctggcgttaattttgccgaactttatgggagtaaccggagtgtatgcagctgaggctatatctgatgcgactgcggccatctgttgcacgttattgttctttgggcagttccctaaaattctgggaaggattaaagggaatactttgcgtgtggagtaatcgtttctttgtattttattttttttacttcacagatatgcatggcattacggttgtattctgactgttatctctctctttatctcatttcctgtgcgtaaatgttgatttatccggatatctgtacctgttaatatatagaaaagtgtgtctgtttgccaggcgatggtaccggctatcctctgatataggatttctcttttcattcttattctgtatccggcaaagatacaaaaaggatgtttgtatcctggcaggaggtaaaaggtgaatctaaaccggatatttttcaattgtgtgagtaactgtggaagtcgggcttttggtaagaagcagttgtagcctgcgaatgggcgtatcgttctcgtagaaattaatgagatattcgattttgttacgaagcatcgttctgcaaagcctcgtacagcttaccggtatgcactggagagaatgcctaaagatatgagagcggaagctatgaaaaaatagcttccttttccttcctttactctgcttttctgtttggttttcgcttaataagcagaagccgttccatatcattgaatagttttgtgtcttttaattcaaacatgatccatttgccgtcgtggaaagtggtagctgcatcatagatcatctgtacctcgtttgaaaactgtccccgctgaatttcaaatttggcacgttcatcttttcctaagataaccataaatcccagagtcttttccttcgcatataaagcacagagggttttaccgcctttgcggtatttgtattcatacgtccacgctttgccgccacggttccaaagtagctccatttcgtagctcttctcgatgcgctggcagagtgagttccatacatcataaaggtctgttcctatcagattctctatatctttggaagtcggtatttgaaaaggttctttcatggtatttgctgttttatcatatatgccgcaaagataggatgatcttttagtaaatcgttgtccaatataggcatcctgggttataattattagaagaagttccattttcatctacatttcagtcttttttttaatttttattgcactttttcaaatatagcaatgagattctagaactaagatgtaaagacatattccatacttcaccgtctagttctgtacagcattgaacaaatttatccctatctttgtcttcttaatatttagagaatagaaaaacaaagaatactggagaaagtagtgggtaagggaacgactttctccctgaacgtatctttgagtattatttaaatcagtagaaaatggggaatttaatttcgtttatgaaggaagtagccgatgggctgcgggaaagtgggaattatgggaccgcccatatttacaggagtagcctgagtgcaatccttgcctttcatggaagtgataagcttcctttccggaaagtaagtcaggagtttcttaaaagtttcgaatcgtatctgcgtggcaggaactgtagctggaatacagtttccacttatatgcgtacgttgcgtgcagtgtataaccgtgcggtcgaccgccatcttgcgccttatgtgcctcatcacttccggtatgtctatacaggaacgcgcgcggacaggaaacgtgcgctggataaggaagacatggagcgtctgatgaaggaacttccgaaacagctgtgtcaggacaacaaggaactacagcgtactcgtggtcttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagccatgaagctgatcaagcggtatatgaatacagatcctgcttctccctatcttttttcgctgatcaccagtggagagggaacggaagctgcttacaaggaatatcagctggcattgcgcaactttaattatcaattaatgattttgaaacaagttttgggactgacatctgaagtaagctcgtacactgcccgtcatacctgggctacgatggcatactattgtgaggtacatcccggtgttatttcggaagcgatggggcattcttccatcaccgtgacggaaacgtatctgaaacctttcaagaataagaaaattgatgaagcgaatgtagcggttatttcttccttgaagaaggtctatcgtgcaggtaagctattgaattagagagctgttactttgtaggtaacgggaagaaaagacgctgcaaatatgggcatattttggaaaacatgcaaacaaaaatgatattttttctgataaactactaaaaaaaggaaacacactgaacaaaactgcggattttttgagaagaacacggcctggtctttaatttttgcaaaagatttccctcccctctgccatcgtctaagagcaggggttaaaaatattctttacttatttaatgaatgtagctcgcagacgcctctgtcggggtggaaaagtatgctttcccgttacctacaaagtaacggaatactaaataataagaacagtattagaaagggattcaaaatgcgagattatttacttttttatttttttaaatttataaatttaaagtttttcaattatgaacaaaaagtttttaagtgtgatcctgtttggagccttgatgacggtttctacgggcacttttgtctcttgtaaggattatgatgatgacattaataatctacaggagcaaattgatggtcagaagaatgatctgaacagcaaaattactgctgtagaaagctcaatcagcagtttgcagactgctcagagtagcttgcagagcgagattgctgctgctaaggatgaggcttcaaaagctgcacttgccgcacaagaagctgcaattgcaacagcaaaagctgaattggaaaaggtaaaagcagaattgcaagcggccgataaggctgatatggcaacagtagacgggaagctggctgaaatatccggtcgtatccaaacactggaacaattcaaaactaccactgaaacaactttggcagctttaagcgcagcagatactaacttgcaaaaaagcatcactactctgcaagctgatgttcttgcaaatgcagaacaaattggtaggaataaagctgccatcgaagctcaaatcgcagctttggaagcatacaagggaacaaatgatgatgccattgcaggtttgaaggctgacttggaaaagttgcaggctggtgaactgacagaagcaatggttgcaaaaattgcagcacaagtaactgaagtcgtaggtgctaaattggaattgatttctgctgcattcagtaaagcagtcactcatgtagagttgtgcgactacacctttggtggtggaaacgaggaccatattatagcaggtgcatcttcaagaatggatttgcgtactactctggctgtagaagaccgcgtgttcggtaagggtagcactgatgaagtagaagctaaagcttacaccattgctaaccaaaaggagtttaagaaaggcgaaagagcattcttgactgattctgtattgatccgtgtatctccgaccaatgcaaccttaaccgaaggacagatttcattcgtaaattcggctcttggcaatttggacaaacttgttactgtagagaaagtagaacaattcaaagggacagttacacgtggtatctctgctaatggattgtggaaagttgtcttcaaactgaacaaggaaaactataccgaagaaaactacctgaaagcagctaagtttgactataagaacggtactgctgaagacagacttgtaaaggaattgaagaacatcagatatgcagtagccgttactgacaaaccgggtgatgtagaacgtaatgtaaccagtggatatgatttgttcttaggctctgattacgaacctcaatatcaattgaccttcaaggttaatgataagaatgtcagtgctctccgtaaccgtttccaacaagcagaagatcaaacatatgttgctgacgccaacaaaaaattgctttacgactacaaatggaacgttgacaatggtgagcgtgtagaaaaggatggttcttatgagtctattattgatgctacctacagttctggtacgtggagagatcaagatctttggtggaacggtgacaatcgtaacactaagtctttcttctctacaaaagtaggtgaaaaatttacagtagaattggatgggtatgatgacgaccagatcagtggtatctacggtttctatgtagtacttgatgagcagcgtgctgtagaaagtgctccatctgaaatcagagcatggaactcttatgaatcagatatcaagggcttgaatactattactactaacagtaagattgagatgtctatcgatacagaaaaagcagatggtgacatcatcggtttccgtgtgtatgctgtaaatcatgacggttcattggttgacccggatggtaaagcattctatgtagcagtaggtgacattgatgcaatgactactacgttgaaggctgattatattcctgtatgggatgctacggctggcgactacaaacgcgtcgttgagttcgctttggatgaggaaattcagcaaatgcttgtagataaatataatgagggttatagttactctagcttggtggttgataaagataataacccgactgcaactaccgcattcattcgtcgtttcaattttgacaatgacaaggtgatgaatataacattaagtaattctttatctcaatacaaggataatggtacttacaagatgtactttaacatcctcaacaagaagaaggtagttgtcaagaaagttgccatcgaaatcaccaagaagctgcctgaattcccagctgcattctctgctaaagctaaccaatttgatgctgaaggtgcaaaagttgttgaagtaacagatgctacttggaactctaacccagttcacaatttaggtacagcattcaatggcatctctgatcctgacaatagtatcattgaccacaactacacatttacttgttcggaaaagaagattgtattcaactcaactctgaatgataacagatatggattcaaacttgatgtaaatgataaggatgcagcagcagatctctttgctgataagtctgcaggaaagatctacgacatcaacgtatcttatatttataataatgtatcttccgagtcagttgacaattcttatactgtaaaagctccggcagctaagaatttcaaattgagattagtatgtggtgaaggatttacttctgaatggaaaaacttcgatgataagaagaatccaattaaacaggtattgaaatatacggatcgagaaacgaaagttaagcttgctgacatcttgaagtttaagaaaggtggtgtagattatacatccacattctctgctgacaacatcaaagaatgccacttagcttctaacagtgtagacgatgaatacttcacagtaacatttgatgctgtaaatcaggaatttgtattcacatcaaaacagagcgctaacccgccgactagtgatgtaactgcaactctgaagtttactatggtagatagctttggacatgaaaatgcagaagaatatccgtatttcactattaaagaaaaataagagaaaacagttgaatggtggtatttgtgaaagtaggccattcctttataatcttaacagatcccttatatttcccttagttactacttttatgtaacattccccactaattaaggagatggttaagaatacagaagtctggacttgtgaaagtatagcttcttataataatgaaggacgttccattgtattcccatggaacgtcctttttaatttttgaaataatagcgaatatgatgaataaaaatataattctattggtattcctctttataagttcttccactctctttgctcaacaaactggtagtacgaatgaacgatctcgtgtgaaagaggaaggaaaaactgtattcaacccgcattggtttttgtcagtgcagggtggggctgcttataccttgggtgaggctgattttggagacttgctctcaccatcagttgcagtagctcttggttataagtttactcctttgtttggtctccgtgctgcagcgagtggctggcaggctaaaggaagctgggtaaatccgaccaccacttactcatataagtatttgcaaggtagtatagatgccatgctcgatctgagtaatttgtgttgtggctttcatcccaaacgatttttcaatgcttatctttttcttggagtaggcttgaatggtgcttttgataatgacgaagctgtagacttggatgcaaatggctataaactgcatcacctgtggacaggtaagaaactttttgttgcgggccgtggaggtctaggcgcagacttccggctgaataatcatatagccattaacctggaagtaaatgccaatatgctatctgataagttcaactccaaacaaggtcgtaatgctgactggcagttcaatgctttggctggtcttgcctttacatttggaaagagctctaaaaagacagctccggtttattatgagcaggaacaaccgactgtaacaaccgtagtggagcaacctgcttcagcgcccatagtggaacagccgcagcctaaagaagaaaagatcgctaaagaacctttgaaacaaaacgtcttctttgcgttgaactcggcacgtattcagacagatcaacaatctaagattgctgctctagtcgaatatatggagaagaatcccgctgccaaagtgaatgtgacaggttatgcagacaaggaaaccggtaatccggtaattaatctgaaactgtccgaagctcgtgcaaagaatgttgccgaagcattgaaggcaaaaggtatttcatctgatcggattgcaattgattttaaaggcgatacagtacaaccttattccactccaaaggaaaatcgtgtcagtatctgtattgcagaataatatttccccgttcttatgtgagatgcagtttttccctgttagcctcttcataagaggaaatctcacagtaagaatatatggaagctgatgcttgtgaaagtgtggacttctatattccctttttcacttgaatgtgaataaatagttgaaagtgtggcaaatgaaagtcctgtgcttgtgaaagtataccttttaatatttgccaccaagaggatgcctcctttattccccacaggcatcctcttttttattcattcctttggatcttcaaaagctatctttatgattgctaaagcatagctttaagtggccatgcgggagatgttacgaacattctttatgatatacagaacaataatatcgttatatttgtatgtcattatttcgggcaatggaaagcgaaaggctctgtttcaagaggaattttgggaaaagggaataacttcttgggaaccaccttttaaagtattatttaaatcaatagacgatggggaatttaatttcatttatgaagggagtagccgatgggctacgggaaagtgggaattatgggaccgcccatatttacaggagtagcttgaatgcctggcttgcattccatgggagtgataatcttccttttcggaggatgcaggattttcttctggctatagatgcatattctgctgcttgtacggataagccagtggaacagataaaatccggattctcggaattactaaagagatatatcgagatgaataatgacaatgtaattggtacttatattcagacagtttaccggtcatcactataatacgaaaaatattctttttcatttctataacaaataagatatacgaatagtagaatacaataaacattttctctataaaaaataatatcttcgagtgcatgaattaattcgtccggctataggcaacgtttcgtccgcctataggcaaacgcaacgtcgactataggcaaacttgcatccggctataggcggacgaattaatttatgcactccaaagtattatttattgcacaagccgggactaaatttagtataggataaaaaaacgcatatgcaaatgaacgcctcgatgggaaaacatttacagttcctcacccaaatggctatggacagtactacaatgaagctgctatacagaaacataaacaagcattatatgcaggtagaaatactagtcaaacagatggctgcagaaatcgaccgacagaaaaacaaggacggacagcaggaaatactggaatccatctcttaatcggttataatcaaaaagtgccgtgatggacaaaaggtgattcagagacgaatcaatcctataaggagggggtattcttcagaaaaatatatcattttccgaaaataccccctttaaaataggggtactttcagaaaaaacatatatttttgcgccatcaaccgataaaaagaagacgatttatgtcaaaaatgagattttacgcattacaagaactttccaaccggaagccgctggaagttactgccccttccaacaaactctctgattattatggtagccacgtattcgaccgcaagaagatgcaggagtatcttccgaaggaagcctataaggctgttaccgatgcaatcgaaaaaggtacaccgatcagccgtgaaatagccgacctgattgccaacggcatgaagagctgggccaagtcgctcaacgtcacccactacacacactggtttcagcctctgacagacggaaccgccgaaaagcatgacggctttatcgaattcggcgaagacggcggagtcattgaacgattctccggaaaactgctgattcagcaagaaccggacgcttcttctttccccaatggcggtatccgtaatacattcgaagctcgcggatataccgcatgggacgtttcttctccggcattcgtagtagataccacgctctgtatccctacgatctttatctcttacacaggcgaagcgctggattacaagactccgcttctgaaagcacttgctgctgtagacaaagctgctacggaggtttgccagctattcgacaagaacgtaacacgcgtctttaccaacttaggatgggaacaggaatatttcctcgtagactcctccttatataatgcacgtcccgacctttgtctgaccggacgtaccttgatgggacactcttccgccaaagaccaacagttggaagaccactatttcggctccattcctccacgtgtcaccgcatttatgaaggaactcgaaatcgaatgtcacaaactgggcatccctgccaagacccgtcacaacgaagtagctcccaaccagttcgagctggctcccatcttcgaaaactgcaacctggcaaacgaccacaaccagcttgtcatggacttgatgaagcgtatcgcacgcaagcatcacttcaatgtattgctgcacgaaaaaccatatagcagcgttaacggctccggcaaacataataactggtcgctctgcaccgacaccggcatcaacctgtttgcccccggaaagaacccgaaaggcaatatgctgttccttactttcctggtaaacgtactgatgatggtatacaagaaccaggacctgctgcgtgcctccatcatgagtgccagcaacagctaccgtctgggagcgaacgaagctcctcccgccatcctctcctgcttcctcggttcacaactctcggcaaccctcgacgaaatcgtacgccaggtaggaaatgagaaaatgacaccggaagaaaagactacgctgaaactgggaatcggacgtatcccggaaatcctgctcgatactaccgaccgcaaccgtacttctccttttgccttcaccggaaaccgctttgagttccgtgccgccggctcttcttccaactgtgccgccgccatgatcgccatcaacgccgccatggccaaccagttgaacgaattccgcgcatcagtggagaaactgatggaagaaggagtgggcaaagacgaagctatcttccgcctgctgaaagaaaccatcatcgcttccgaagccatccgctttgaaggcgacggttactccgaagaatggagacaggaagctgcccgccgcggactgaccaacatctgccacgtgccggaagcgctgatgcactacgtagacaaccagtcgaaatcggtactgatcggcgaacgcatcttcaacgaaaccgaactgaacagccgtctcgaagtagaactggaaaaatacaccatgaaggtacagatcgaggggcgtgtattgggcgacctcgccatcaaccacatcgtgccgacggctgtcacctaccagaaccggctgctagagaatctgtgcaaaatgaaagaaatcttctctccggaagaatacgaagtattgagcgctgaccgcaaagaactgattcgtgaaatctcgcaccgggtgacttccatcaaagtactggtacgcgaaatgaccgaagcccgaaaagtagccaatcacaaagataactacaaagagagggcattcgaatacgaagaaaaagtgcgtccttacctcgataaaatccgcgatcatatcgaccatctggagatggaggtagacgacgaaatatggccgctgcccaagtatagggaactcttgttcaccaaataaaaaactcctgaagattgcacgaaagaacctacttttgtgcaatctttttatagattcgttcattttctcattttttctttctacttttgtgctgtataacacagttttgtagcacccatggtaaaaatgaacatgtcagacatcgatatttcggaaccattatccgatttgttagctcctttgaataacgaacaaagggagtttctgatgaacaattatacgatacagacctacaaaaagaacgaaaccatctactgcgaaggggagactccctctcatttgatgtgcctcattaccggcaaagtcaaaatcttcaaagatggtgtaggaggtagaagtcagattatccgcatgattaaacagcgggaatactttgcgtaccgtgcatacttcgcaaaggaagacttcgtaactgccgccgccgctttcgaaccttctgttatctgtctcatccccatgactgccatcaccacgctggtcgctcaaaacaacgatttagccatgttttttatccgccagctttctatcgatctcggcatttccgacgaacgtaccgtcagcctgacacagaaacatatccgtggacgtctggcagaatcgctgattttcctcaaagagagctatggactggaagaagacggatcgacattgagtatttatctttcccgtgaagacctggcaaatctgtcgaacatgaccacctcgaacgccatccgtaccttatcacagttcgctacggaacgtctgatcaccattgacggaagaaagatcaagatcatcgaagaagaaaaactcaagaaaataagcaagataggataatacagaccttatacgatcataaaaagtgatctgaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaactggaagccgatgttcgtcacatcggcttttttatttctatactgttggaacttaccaattaaacaagtacatttgtcctgtcaatatattaataacttaacacaatttcagaccatgaagaaaagtatttcccttcttcttttatccttgctcatgattacccccagttgtcagaagccaaaagaagtgacgaacgagtacaacatcgttccgcaacccaaccagcttgttcccaaagaaggccgcttcgaactgagcaacaaggtccggctggtagttccgtctgatgctccggaagttaaaaaggtagccgacggctttgccgaacagctgaaacagactgccggaatctctctgacagaggccgaaagcgtggatggaaagcctgctatcagtttcgtactacaagaaggtatgcctaaagaaggttacaagctgtctgtcacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagagatcgaagacgctccccgctttgtacatcgcggactgatgttggacgtttgccgtcattacgcaccgatagagtatatctacaaatttatcgacctgctggcaatgaacaagatgaacgtttttcactggcatctgacggacgatcagggatggagaatcgaaatcaagaaatatccgaaactgacagagataggttccaaacgcgaaaaaacgctggtagactattattatgtgaactatccgcaagtattcgacggaatagaacacggaggatattacacacaggaacagataaaagaggtggtagcttatgctgcaagcaaatatatcaatgtaatccccgaaatagaaatgccggggcatgcattggcggctctggctgcttaccccgaattgtcttgtgattctacacagacatataaagtatcacctacgtggggcgtattcgaacaggtattctgcccgagcgagaccactttcaagttctttgaaggagtcatggacgaggtagtcgaattatttcccagcgagtacattcatatcggaggagacgaatgccccaaaacagcctggaagaacagtactttctgccagcagttgattcgtcagttaggcttgaaagatgacgcgactcccagcaaagtggacggagtgaagcacagcaaggaagataaactgcaaagttacttcgttacccgcatggaaaaatacctgaacggtaaaggacgcaatatcatcggctgggacgagattttggaaggcggcctggctccaaacgccactgtcttgtcatggcgtggcgttgaaggcggattgaatgcggccaaagcaggacacaacgcaatcatggctcccatgccttatgcttatctggacttctatcaggaagatccggaaatcgccccgactaccatcggcggatacacaacgctgaagaagacttatagctacaatcctgttccggataatgccgacgaactggtgaagaaacatatcatcggtatgcaaggcaacctctggagagagtatatgaaaacttccgaccgggtagattatcaggccttcccacgtgcgatggctatcgcggaaacgggatggacactggatgccaacaaaaactggaagagtttctgcgaacgcatggttacggaatttgagcgcctggaagtcatggataccaaaccctgcctcaacttcttcgacgtaaacatcaatacgcatgcggatgaaaacggtccgttgatggtattgctggaaacattctacccgaatgcggaaatcagatacaccacagacggcagcgaaccgacttacggttctacactgtatgaacagcctttcgtgcttgaaggaaacatcgacttgaaagctgctgctttcaaagacggcaagatgctgggcaaagttaccaacaagccattgtatggcaatctgctggcaggaaaaccatttaccgtcaattatacaatgggatggacaggggatattttcggcgacaatgatgtattgggagctgacaaaacaactttcggtctgacaaatggaaagagaggtaacaatgcttcttacactccgtggtccagtttcgcaatcgtagaaggtaaagacctggaattcatcgtccatctggacaaaccgacggaagtaagaaaagtggtcttcggctccttgtttaatcctgccatgagaatgctccctgccggaggagttgccgtagaagtatctgccgacggtcagcaatatactcagatagccgaaaaggccttgaagcatgattgtccggaaacgggaagaatcgcattcaccgactctatcgaatttgaaccgacacaagccactttcctgaaagtaaaaatcaaaaatggcggtaccttgcgtaatggcgtcaatttcaaaaagaacaacggtccggaagtcattcctgccgaattgtggatagacgaaatcgaggcatattaatgcctgtgacataacaaaaaacggtggacatgcagcttgttgctcatgtccaccgttttttttattgattcagttcttatttattccatgcaaagcattccgccttgcttcatctttaaataattccctttgcagaaagataacgttccgcctcgatagcagccttacagccacttcccgctgctgtaatagcctgacggtaatgcggatcagccacatctcccgctgcgaatactccgggaactttcgtacgggggctgtcaccatctgtaataatgtaacccacttcgtcagtgtcgatatactctttgaaaatatccgaattcggtttgtgaccgatagccaggaagaaaccgtcgataggcaggctgtaacgttcttcgtccgattcgccccaacgcttcacaacattcataccttctacgccgttatcgccaaacaggccgactacattgtgttcgaaaagtacttcaatcttctcgtgcttctgcacacgttcctgcataatcttcgatgcacgcaggtaaggtttgcgaaccaccagatatactttggatgccagaccagccagatagatcgcttcctcacaggctgtatctccaccgcccaccactgcaacgaccttcttccggtagaagaaaccgtcacaagtagcacaagcgctgactcccattccggcgtatttcttttcgtcttccagccccaggtatttggccgtagctccggtagagatgatcaatgcttccgtttcaatcaccttatcgccgtcaatcgttatttgataaggagctttgctcaaatctgccgctgtcgcaataccgaaacggacgtccgttccgaaacggctggcttgcgcgcgtaaatcttccatcaactgcggaccactgattccttccggataaccggggaagttctccacatccgtggtagtcgtcaactgaccaccgggctgcaatccttcataaagcaccggacaaaggttagcacgtcctgcatagatcgctgccgtatatccggcaggccctgagcctataatcaggcattttactttttctatttctgccattttattgttatattattgttttatattccaactatctcgtctcttactcaaaagaatattctatcgtaagtctatcacttccgcagtggggtatgccttccggtcgaaagtgaaaacatgatccgcataatccagtccggtctgataagctgtcacggtaatctcattacgcgtttgctgaccacgttgctgaagctgaatgtaaaccggttcatacgtactcttcgtcacataaagcgtaatgctttccaactcttgctttttatcattggcagtcagaatcacttcccaaacagctttaccctgatatgtcttcacagttcccagcttataagagaatcctttctgatacatataaagaaaggtatacggattgatctgctgcaactcttcctgagtgggattgctgacattcacttcatcatttctcaccatgtagctccactgtgttttcccgtcaaaccaagtggtggtctcggaagtcttcagcataaacttctcgcccttcaactgaatgataccgttctcccgcccttccaaacgaccgtcattgacagccttcaaggtaaaatcggccctcacaccacctgccttcttaaacgcttcggccgtcttctccagaacagctttagcctgcgactgctgttgttgagcaatcacaggcagtgacagtaaagctattaaaacactaaaaatgtatttcttcatttgattaataaacgatctgttattgtaaattgttcaaacgcatttcaagatcattatcgtcgacacagagtacgtcacgagccttgcttccctgtgtaggtccgacgattcccgccttttcaagctggtccatgatacgtccggcacgattgtaaccgatagcaaatttacgttgaattaacgaagtggaaccttgctgatggatgaccaccaagcgtgccgcatcctcaaacaacggatcgagacgtcccatatcaatgtcgcccacttcactgccgctgtcttcgctcacatactcgggcaggaagaacggagtaggataactctgctgacgagcaataaatttcgtgatctcctccacttccggcgtatcgataaaggcacactgcacacgtaccggatcagcaccttgcaggaagagcatatctcccttaccaatcaggcggtttgcccccggacggtcaagaatcgtacgggaatccatcatggcggatacacggaacgcaatacgtgcggggaagttcgccttgatcgtacctgtaatgatattcgttgtcggacgctgcgtagcgatgatcatatgaataccgaccgcacgtgccaactgcgcaatacgggcaatcggaagttccacttccttaccggcagtcatgatcaaatctccgaactcgtcgatcaccaccacgatatacggcataaacttatgtcctttctccggattgaggcggcggttgataaacttctcattatactccttgacattacgtacatgagccatcttcaagaggtcatagcgtgtatccatttccacacaaacagaattcagcgtttgcactaccttggtcacgtccgtaataatcggttcgcctccatcaggaagtttggccagaaaatggttttcaatgacggagtaaatgctgaactccaccttcttcgggtcgaccagcacaaatttcagttcagccggatgtttcttatataataaggaggtaatgattgcattcaagccgacagacttaccctgaccggtagcacctgccaccaacacgtgcggcatcttgcaaaggtcgaacatgaacacttcgttcgtgatcgtcttacccagtacaatcggcaagtcaaatctggattcctggaacttcttgcttccaatcacgctctgaccggatacaatcttcggattcttgttcggaacttcgataccgatggttcccttacccggtatcggagcaatgatacgaataccatccgccgacaagctcagggcgatatcatcctccaagccacgaatcttcgagatacgcacaccctgttcaggagtgatttcataaagagtcaccgtaggacctaccgtagctttgatcgtactgatttcaatgccaaagctgcgcaatgtattaatgatacggtctttattcgcattctgctcgtccatgtcgatcgtcggatcgtcattctcaaaatgcttcatcaagtcgattgtcgggaaacggtaattttccagatccttcatcggattataaggttcttgctccggaccctgatattcttcttccgacgcagctgtctctacctgaaatccgggttcatcctcacccggcaattcatcctgagcaattggaggaaccacatcgcttacggtcggttcaaagaccatagtcaccccttccgcctcatcagcagaaggaagttcgtcgtccggttccggtgcgttgaccggagattcttctttcggctcttctgcctgtatatccatcacgggagcaggaggaggtgtttgcttataagtacgtttcagattgaactccacttcctgcggttgcgaggtcgtgaactcctgtgttccttctgccgcagtctccttttcttcttctttcttctgacgtttgaggaaactcagagcaaaaagtttgcgcaaccagattactgtccgtgcacttatatatataaagaagcagacagccgttatcagcaggatcatccatactccgggaactcccacctgcgaaaccagccagcggcttacattgtaaccgtgcatacctcccagataaatgaaagaatcctgataatgatccatcaaagcgaagccgaagaatacggagaaccacaccaataataatgtacaaccgataaaccatttccacagacggacaatgcgcacccgcatcagtttcaatcctgccaccgccagaaagacgaggataaagaaagaagatatcccgaagcagtcatttatcagatagctagctaactgtgctccgcgagatccggcatagttttttacattattattaaccgccgcaaggtctgccgagctgccgctgtcgataatactttggtcggccgcccccgtaaagaagaaggaagaaaaagccaacaaaagataaacggaaaagatcaccagcatcaatccgagcacaaaatgaacggtttcattcttaaaaattgatacaatctttccgggagaagacggagtgcgttcagcctccttatctattttcttttttgccatgagtctttattctttaaataaattggaatccgtattataagccgcaaaaataataaaaaaataacgagcagtactctcattcaatcctttttcttacctttgcgattcaaatcaatctgattatggaaaaagaaagccaaacgatatttgaaaagaatgtgatcgagttcgtaacggtagccgccgaattttgcgcattcctcgaacgtgccgaacacatgaagcgcaaagcttttgtcgacacgtccttaaaaatacttcccctgctctatctcaaagcatccttgcttccgaagtgtgaaacaatcggagacgaggcacccgaaacgtatgtgacggaggaaatttacgagattctgcgtatcaatctagcagggctgatgggtgaaaaggatgattatctggacgttttcgtacaggatatggtgtacagtgaccagcctatcaaaaagtccgtctcggaagatttggcggatatctatcaggatatcaaagattttattttcgtcttccagctgggactgaacgaaaccatgaacgactcgttggccatctgccaggaaaacttcggtctgctgtggggacagaagttggtaaacactctgcgtgcccttcacgatgtgaagtataaccagcagaatgagaatgacgaagaagacaacgaggaagagaataacgaactaagcgatgacgactattgttgtgaagaagacggttgtcactgccacgacgacgaatgtcattgtcatgaggacggttgccattgtcgtaatgacgaataaacaaaaatgatagtaagaagaagtataaataaagacgaactaaaggaactcccgaaaactgtatttccgggacgaatccatgtgatccagtcggaagcggaaacagaaaaagcagtagcttacctgcaatctcagccgatactgggtatcgatagcgaaacgcgcccatccttcaccaaaggacaaagtcataaagtagcacttctgcagatttcttcagacgaatgctgtttcctgttccgcctcaatatgaccggactcacccaacctttggtcgacctgctggaaaatccggctgttatcaaagtaggactgtcgctcaaagacgactttatgatgctgcacaaacgtgcaccttttacccaacagagctgcatcgaactgcaagactatgtacgccagttcggcatacaggacaaaagtctgcaaaagatttatgcaatcctgttcaaagaaaagatttccaaatcacaacggctgtccaactgggaagcggacgtactgagcgacggacagaaacaatatgccgctaccgatgcctgggcttgcctcaacatctacaacctgttgcaggaactgaaacgaaccggcaactacgaggtcgaaagcctccctgtagaagaagaggttgacgcaaatgctcccgccaatcgctgacaaatgaccgataaaagactaattaataactgataaaatagcattttaaacaacatgcataaagtatacctcaaacccggcaaagaagagtctttaaaaagatttcatccctggattttctccggagcaatcgctcgtttcgatggagaacccgaagaaggtgaagttgtagaagtatacacttcgaagaaggaatttatagccgaaggacatttccagatcggaagtatcgccgtacgtgtgctctctttccgtcaggaacccatcgaccacgatttctggaaacgtaaactgcaaattgcctatgatatgcgttgtggaatcggtatcgcagtcaatcccaccaatgacacctaccgtcttgtacacggtgagggagacaatctgcctgggctggtcattgacatttatgcccggactgccgtcatgcaggcgcactccgcaggaatgcatgtagaccgcatgactatcgccgaagccctgtcggaagtaatgggtgacaagatcgaaaatatctattataaatcggagactacactgccttttaaggcagatctttttcccgaaaacggtttccttaaaggaggaagcagcgataatatcgcacgggaatacggcctgaagttccatgtagactggctgaaaggccaaaagacaggattcttcgtagaccaacgcgaaaaccgttcactgctggagcattattctaaagaccgttcggtactgaatatgttctgctacaccggcggtttctccttctacgctatgcgtggaggtgcaaagctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccaatacgatttgataatcctcgacccgcctgcatttgccaagcataaggatgctttgcggaatgccttgcaaggttaccggaaactgaatgccaaagcattcgaaaagatcaaaccgggcggcatcctgtttactttctcctgctctcaggtggtaaccaaggataatttccgcacagctgtgtttaccgctgctgctatgtcaggacgtagtgtacgtatcctgcaccaactaacccagcctgccgaccacccggtaaatatataccatcccgaaggagaatacctgaaagggctggtactctatgtagagtaatatatgtcataaacaccatgaacttgcataaacaaggggtgaataaaagaaaaataatagtttcaaagttaattagagttaacaaatagaagtttttcggcaaatcattatgttctataacataaaaccctttatatttgcactgtgtttttcatggtattagatttaaggttaataaagattggctgtctgggatagatagccttctttttttatatgcctatccaccctctttttaacagtaattcttcactattcttcgcatttatggcttttttatcccctttttatcgattaacttgtccacccaatcaacgaaaatattatatttgcatctattattaacgtaaaaagagaaacacaaattagaaaagtcatgagtataaaagttcgtttgatcattatgaacttcctgcaattctttgtatgggggtcatggttaatttcactagggggttacatgggcagagaactccacttcgaaggaggacagatcggtgccatcttcgccaccatgggtattgcctctttagtcatgcccggcatcattggtattatcgccgataaatggttcaatgccgaacgtttatacggactttgccacatcgcaggggcagcttgtcttttctatgcctctaccgttacgaattatgaccagatgtattgggctatgctactcaatttattggtatatatgcctaccctgtcactggccaataccgtttcatacaatgcactggaacaatataaatgcgacctgatcaaggacttccctcctatccgtgtatggggaacgattggttttatctgcgccatgtgggcagtagaccttaccggattcaagaattccagcgcacaactttatgtaggcggtgcatccgcactcttgctgggtttatactctttcaccctgccggcatgcaaaccggccaagacagaaaagaaaacattactttcttccttcggactggatgcattcgtattattcaaaagaaagaaaatggctattttcttcctgttctccatgcttttaggagcagcattgcagatcaccaacacgtatggtgaccttttcctcgggagcttcgccagtattccggagtttgcagattctttcggagtaaaacattcggtgatcctgctgtctatttctcaaatgtctgaaacattatttattctcgctataccattcttcctgagacatttcggcatcaagcaagtgatgctgatcagtatgttcgcctgggtattccggttcgggctgtttggcttcggagatccgggttccggtctgtggatgctgattctttccatgatcgtgtatggtatggcgttcgacttcttcaacatttcaggttcgttgtttgttgaacaagaaaccagttcctccatccgtgccagtgcccaggggttgttctttatgatgaccaacgggttgggtgccatcatcggaggatatgccagcggtgctgtcgtagacgcattctcagtatatgctgatggcaaactagtgagccgtgaatggccggacatctggtttatctttgcggcgtatgcactggtgatcggcatcctgtttgctctggtattcaagtacaaacaccaacgagagaataaagtaaattaagtaaaaaagaacaatggacaaaaaagtagaattacaagttttaaatatcacaaatagccaagcgcaagtaggcgcttttgccctactgttgggtgaagtgaacggtgaacggcaactgcctatcatcataggtcccgctgaagctcaggcaaccgccctgtatatgaagggggtcaaaactccccgccctctgacacacgacctgttcatgaccattatcggcgtattaggagctagtttgctccgcgtattgatctacaaggcgaaggacggtattttctattcctacatttaccttaaaaaagacgaagaaattatacgtatcgatacacgtacctcggatgctgtcggtatggcaatccgtgctgaatgtccgatcctcatttatgaatccattctggaacaggaatgccttcggatatcgaacgaggaaagaagacatcctgaagagtctgatgaagaagcggaagacgaaaagaagcgggatctgcctcgcaacgttacttcaatgtcactcgaagaagcattggatcaagcaatcaaagacgagaattacgaactggctgccaagatacgcgaccggatcaattcaagaaatcaaaaccactaaccaattatgcacgtattttatactcccgatatacagaaaaactacgaacttccggaagaggaagcacaacattgtacccgcgtcctgcggttgggtatcggagacgaaatcactcttacggacggtaagggacatttctataaagcagaaatcacggttgcaaccaacaagcgttgccttgtagccatcaaagaaacaatctttcaggaaccgctctggccgtgtcatctgcacattgccatggcgccgaccaaaaatatggaccgcaatgaatggcttgccgagaaagctacggaaatcggatttgacgaactgacttttctcaactgccgtttttccgaacgcaaggtgattaaaaccgaacggatcgaaaagattctgatatcagccatcaagcaatctcttaaggctcgcctgccgaaactcaacgaaatgacggacttcgacaagttcattgcacaagagtttcaaggtcagaaatttattgctcactgttacgaaggcgaaaagcctcagctgaaaaatgtactgaaagcaggagaagatgctctcgttctgatcggtcccgaaggagacttcagcgaagaggaagtgaagaaagccatcgaatgcggattcactcccatcagcttgggtaaatcacggcttcggacagagacagcggcactcgtggcttgccacacaatgaacttattgaaccaataataacttttaaatagtatgagtatggcaaagaaaatgatctcacggctctcggtactggcagtactgattgtgtttctggcagcatgttccaaacaaacggaatatacgaacgtaataccggcagacgctacggctgttgcctctattgatttgaaatcactggccaacaaagccggaatgaacgacaaagaaaatgaagctgctaaacagaaactgctggaagcaatgaaaagcgggatgaatgctgccactttccaacagttggagaaggtgatcaacaatccgggagcatccggtctggatccggaagcaccgatctatatctttagctctccccaaatttccggtggtgcattcgttgccaaagtcagcaatgaagacgatttgcacgcttccctcgatgtgatggcaaaagaacaaatctgccagccggtcagcgaagcggacggatatagcttcactaccctgaacggaaacttgcttgctttcaatgaaaccactgcaatcattatctctgccagcagaacttctcagacagaagcagccaaagaagccatcaccaaactaatgaaacagactgccgacaacagcattgcgaaatccggagccttccagaaaatagccaagcaaaagagtgatatcaacttcttcgcctccatgtcagcaatcccttctacttacagaagccagatcagcatgggacttccttctgaaatcaaaccggaagacattaccatcctaggcggactgaacttcgaaaaaggcaagatcgcccttaaaacagaaaactacacggagaacgacgccgtcaaagcgcttctgaaaaaacaaatggaatcatttggaaagacaaacggcacattcgtgaaatactttccggcatctacgctgatgttcatcaatatgggcgtaaaaggagacggactttacaatctgttgagtgagaataaagaattccgcagcactgtgtctatcgccaaagcggatgaagtaaaagaactgttcagttcattcaacggcgatatctctgccgggctgatcaatgtaaccatgaacagtgcccctacttttcttgcttatgctgatgtaaagaatgggaatgctcttgaagctctttacaagaacaagcagtcactgggcatgagaaaaggagaagacatcatggaactgggcaaagacgagtatgtctacaaaacaagaggcatgaatatatttttcggcatcaaggacaaacagatgtatgctaccaatgacgaactgctctacaagagcattggcaaaacggttgacaaatcgatcaaagacgctccttacgcagcagacatgaaaggcaagaccgtatttatggccatcaatgcagaagccatactggatttaccggtcgtaaagatgctggtaggcttcggaggcaaggagttcaagacttattctgatctcgcttccaaagtttcttatttatccgttagttcggaaggagaaacaagcgaaacagacctttgcctgaaagacaaagatgtcaatgccctcaaacaaatcgtagattttgccaagcaattcgccggcatgtaattcgtcaatgaacggcatgaatagtattcacttacagcaaacacttccccaagtgtttgctgaccgtaattcggtgacctctgatgtatggcatcaggaccttatcttccggaaaggagaaatgtatctgatagaagccgcctcaggcaccggaaaatcatcgttgtgcagctatctttacggctatcgcaacgattatcaaggaattatcaatttcgatgaaaccaatatcaaagcatattccgtgaagcaatgggtagacctgagaaagcattcactgagtatgctttttcaagacttgcgtatcttcaccgaacttacagcgatagaaaacgtacaactgaagaataaccttaccggacacaagaagaaaaaagagattctttcattattcgagaagctgggtatctcagataaactgaacgtgaaagccggaaaactttctttcggccaacaacaacgggtcgcttttatccgtgcattctgccagccgttcgacttcctgtttctggatgagcctatcagccatttggatgatgagaacagccgcatcatgggagaaatcatcattgacgaagccggaaaacaaggtgccggagtcatcgccacgtccattggcaaacatatcgaactgccatacaagaaggtgcttcaactataatagaatctgcgtcattcgcgcctaaaaatataaaaatacaaaataatgaatacccttgtctggaaacttctccgccaacatatcagtatcggtcagttagccggtttctttttagccaacttgttcggcatgatgattgtattgctcagcgtacagttttacaaagatgtcattcccgtattcaccgaaggagacagctttatgaaaaaagacttcatcatagcaaccaagaaaatcagtacgctcgggtcttttgccggaaaaagcaatacgttctctcccgatgacatcgccgatctgaaaaaacagtcgtttaccaaaacgataggagctttcaccccttctcaattcaaagtttcggcaggattgggaatgcaggaagcgggtattcatctctctacggatatgttcttcgagtcagttcccgatgaatttgtagatatcaaactcgataaatggcacttcgacgaagaaacacataccattcccatcatcatcccacgcaattatctgaatctgtataacttcggtttcgctcaaagccgcagtctgcctaagttgtcagaaggactgatgggacttattcagatggacatcatgatgcggggcaacggacgggtagaacaatacaagggaaacatcgtcggtttttccaaccgtctgaatacgattctcgttccgcagtctttcatgaactgggccaacaagaacttcgcccctgacgcggaggcacaacctgcccgactgatcatcgaggtcagcaatcccgccgactcttcgattgccagctactttcaaaagaaaggctacgagacggaagacgggaaactggatgccggaaagactacttatttccttcgccttatcgtaggtattgtgctgggagtaggtttattcatcagtatcctgtcattctatatcctgatgctcagcatattcttactgctccaaaagaatacaaccaagctcgaaagcctgcttctgataggctacagccccaacagagtggcgctgccttatcagatactgaccgtaggactgaacatcatcgtactgattttatctgtcggattggtatgctggctgcgcagctattacatagagagtatcagactcctcttcccgcaactggaaaccggttcgttatgggcagctgtcagtatgggtattcttttattcctcatcgtatcagtcattaatatactggctgtgaagcgaaaagttctttctatctggatgcataaaaattaaaaacacaatatatgaaaaacaccactactcttcaaagtaaaagaagtattacagtactcttgggagtccttctatatttctcatcgctatctgcacagaccatgcaagatacgattatagctaacttcagtctgatggaaagaattcctaaagaaaagttgtacctccatctggacaagcctttctacggagccggagaaaagatatggttcaaaggctatctggtgaacgccaccacccatcaggacaactcacaaagtaattttatcattacggaactgatcaaccgttccgactccattgtggaacgaaagaaaatccgcagagattctctcggattccacaacgccttcaccctccctgccacccttccggcaggcgattactacctgcgggggtacagcaactggatgctgaatgaagaccccgactttttcttttcgcgcaacatcaagataggaaactctatcgacaataccatcgtttcgagcattgagtatcagcaagaagacgatacacattacactgccaaaatcaaatttacaagcaacgtacaggctgttttcgaaaatacaacgatcaaatacctataccttgagaatggtaagataaaaaacaaaggcaaaaaaaagacggacgaaaacggctggatttccatttccctgcccgatttaaaatctccggcagcgcgcagaatagaagtagaatttgacgatccgcaatatatctacaaacggactttccatctgccggtgttcaccaatgatttcgatgtgaagtttttccccgaaggcggtgccctactcagcattccccatcagaatgtcgctttcaaagcacagggagcagacggtttttctaaagaagtcgaaggtttcttgttcaactccaaaggagacacgcttaccaatttccggtcggaacacaacggtatgggtatctttacaatgaatcccgtcaacaatgagacttattatgttacggtaagaaccaatgacagtattaccaagcgatttgaccttcctgccatagaaccgaaaggaatctccatcgccatgtcgcactataaacaggagattcgctacgaaatccaaaagacagaagcgaccgaatggcctcagaaactattcctgcttgcacatacccgtggcaaactggccattttacaacccatcaatccgaaaagaactttcggaaagatgaatgacagcctgtttacggaagggatcactcacttcatgctgattgatgaacaaggaaatgcacttagcgaacggttgattttcgttccggatcataagccgaatcaatggcaaatcactgcagaccaaccgacgtatggaaaaagagagaaggtatctttgcagatcgctgccaaagacaacgaaggtaacccggtagaaggaaccttctctgtcagcatcaccgaccggaaaagtattcaacccgactctcttgccgacaatatcctgtccaatctcctgctgacttcggatctgaaaggatatgtggaagaccccgcatactattttctaaatcaggacgcccggacgctccgttccatcgactatctgatgatgacacatggttggcgcaggcataaaatggaaaatgttctccgcactccttcgctgaatttcacaaattatatagaaaaaggacaaaccatcagcggacgaatcatgggattcttcggagcaaacgtaaagaaaggtcccatctgtgtactggctcccaaatacaatatcatagccaccaccgagacagacgagaaaggccagttcatcgtcaatacctcattcagagacagcacgacattccttgttcaggcacgcaccaagaaaggatttgccggtgtagatattctaatggatcctccccagtacccggtcgctacgcataaagccccttattttaacggagcaactacctttatggaagattatctgatgaatacccgtgaccagtattatatggaagggggaatgcgtgtgtacaatctgaaagaagtgacagttacagcgaagcgggaacgtccgagttcaaaaagtatctatacgggaggtatcaacacctatactgtagaagaagacagactgcaaggatacggtcagacagcttttgatgcagccagcagactacccagcgttacaatcacgaacggaagtgagatacatatccgtaacaattccgaaccggcaatcattgttatcgatgatattgtgtatgaagatgcttccgatattttgaaggatatccaagtcagtgacatgtccagtatcagtctgcttcgaggagcagatgccgtcatactgggtccccgtgcttccggaggtgccgttgtcatcactctgaaagaccctagaaatcttccggccagaccagcgcagggaattatcacttatacgccgctgggatacagtgagtccgtagaattctatcaccccacctatgatactcccgagaaaaagaacgctcagcgttcggacttccggagtaccgtttactggaatccggaattacggttagacgccgaaggcaaagcgaccatagaatactatacaccggacagcacagctcccgaagatatcattatcgagggcgtggacaagaatggaaaggtatgtcgtatcctacagaccattaataagtagcttttctcaacgcttcttcaaacttttatgtagttcaaatttgagttctgcttcctattaaataatcagataaaagcatccaaataacccactgggtcaaaattattttgtatttttgccgtcattaaagaataaagctatgccggactatgatttaatcaccatattagggccaacagcctcagggaaaactccttttgctgcagcattagcccatgaactgaatacagaaattatcagtgccgactctcgtcagatctatcggggaatggacctcggtacgggcaaggacttggcagattatacagtcgacggacatccaattccttatcacttgattgatatcgccgatcccggatataaatacaatgttttcgaatatcagcgggatttcctgatttcttacgaatccatcaaacaaaaaggctgtctgcccgttttatgtggagggacaggtatgtatctggaatcggtactgaaaggctataagctgatgccggtaccggaaaatccggagttacgtgcccgtctggctaatcactctctcgaagaactgaccgaaatcctgaagcaatataaaacattgcacaactctacggatgtagataccgtgaaacgtgcaatccgtgcgatagaaattgaggagtattatgccgtgcatccggttcccgaacgggagtttccgaagttgaacagcctcatcatcggggtagatatcgatcgggaactgcgtcgcgagaagatcacccgacggttgaaacaacggctggacgaaggaatggtggatgaagtaaggcgattaacagaacaaggcatttcaccggacgacttgatttattacggactggaatacaaattcctgacgttatacgtcataggcaaactgacttacgaagagatgttcactgagctggagacggccatccatcagttcgccaaacgtcagatgacttggttccgcggcatggaacgtcggggatttaccatccactgggtcagtgcagagctgcctatggaagaaaagatagcctttgtgatagaaaaactgcgagggaattagtatctttgccagtcatttacgaatggtctgtgaaagataaaaaatgcgattgttaatacagttaggatagaaatacggttatgagtgtagaacctggaaaatggggagtgatctacaaccccaaagcaggtacccgaaaggtacagaaacgatggaaagaaatcaaggagtacatggacagcaaaggtgtcaactatgactatgtacaatccgaaggtttcggttctgtagaacgtcttgccaaaattctggcgaacaacggctatcgtaccattgtcatcgtaggtggcgacggtgcgctgaacgatgccatcaacggtatcatgctctctgatgccgaagacaaggagaacatcgcccttggcatgattccgaacggtataggaaatgactttgccaaatactggggactcagtaccgaatacaaacctgccgtagactgtatcatcaaccaccgtctcaagaaaatagacgtaggcttctgcaacttctacgacggcaaggaacaccaacgccgttatttcctcaatgcagtcaacatcgggctaggcgcaaggattgtgaaaatcaccgaccagaccaaacgtttctggggggtgaaattcctgtcgtacgttgccgccctcttctcgctgatattcgaacgcaaactataccggatgcaccttcgtatcaatgacgagcacatccgcgggcgcatcatgaccgtatgtgtaggaagcgcctggggctggggacagactccgagtgccgtaccctacaacggctggctggatgtatccgtcatctaccgtccggaattcctgcaaatcatttcgggattgtggatgctgattcagggaagaatcctgaaccataagatggtgaaaagctatcggacaagaaaagtaaaagtgctccgcgcacaaaatgcttccgtcgatctggacggtcgcctgctggcaagacatttcccactggaaataggcgtattatcagaaaagacgaccctgattattccgaattagccaacagaaccgggcttctggcgaaaaacagcccttcactcatgaaactataaataagtaattagtaacttgtaattaataaaatgatcgaacttaagaacaatcctgccggtaacttctttctgctggccggtccatgtgtaatagaaggtgaagagatggcaatgcgcatcgctgagcgtgtggtcggagtcactgaaaaattacagattccttatgtattcaaaggttcttaccgcaaggcaaaccgttcgcgtcttgattcattcacaggtatcggtgacgagaaggcactcaaagtgctgaaaaaggtacatgatactttcggagtgcccacagtgacggatatccattcggccgacgaggctgagatggctgccgaatacgtagacattctccagattccggctttcctttgccgtcagacggatttactggttgctgctgctaaaacgggtaagacgattaacatcaagaaaggacagttcctctctccgctcgccatgcagtttgccgctgacaaagtggtggaagcaggcaacaagaacgtgatgctgaccgaacgcggaacaaccttcggttatcaggaccttgtagtagactaccgggggattccggaaatgcaaacgttcggttatccggtcatactggatgtcacccattcattgcagcaacccaaccagaccagcggagtgaccggtggtatgccccaactgatcgaaaccgtagccaaagccggcatcgccgtaggagccgacggtatctttatcgaaacacacgaaaaccccgccgtagccaagagcgacggagcaaacatgttgaagctggaccttctggaaggactattaacgaaattagtcagaatacgggaagctatcaaataactcttttttctgcccgtttgtgattatacacaaaagaatacgacagatatttcaaacaacttttttataaactaaatagaacatgaaacatttattacgtggattttttattgcagttctctatatatgctgcaacttccaactcgtgcttgcacaacctatgcaaacactgcccgtggacaaaaatgtccgcataggtaaacttgacaacgggcttacttattacatccgacacaacgcactcccagaaaaacgcgtcgaatttcacattgcacagaaagtgggttccatccttgaagagccgcaacagcgcggtttggctcacttccttgaacacatggctttcaacggaacaaaaaacttcccgggtgatgaaaccggactgggcatcgtgccttggtgtgagactaaaggtatcaagttcggaacaaacctgaatgcatacaccagtatcgacaaaacagtataccgaatcagcaatgtacctaccgacaacgtcagtgtagtagactcttgtctgctgatcctgcacgactggtcaagcgccatcaaccttgccgacaaggaaatcgacaaagaacgtggtgtgatccgtgaagaatggagaagccgtaacagtggtatgcagcgcatcatgaccaatgccctgcctgtcatgtatccggattccaaatatgcagactgtatgccaatcggaagcctcgatgtaatcaacaatttcccttatcaggacatccgtgactactatgcgaaatggtaccgtccggacctgcaaggtatcatgattgtcggcgacatcaatgtagatgaaatggaagcaaagctgaaaaaggtatttgcagacgtgaaagctccggtgaatccggctgaacgtatctactatccggtagcagacaatcaggaaccgcaaatctttatcggtacggacaaggaaatcgaaactccttccatcagcttcttcttcaagagcgaagccttcccggattcactgaagaatacaatcaactattacggcattcaatacatgattagcatgggagttacaatgctgaacagccgtttggcagaaatccgtcagcaagcgaatcctccttttacaggtgcaagtgcaggttatggcgacttcttcgtagccaagaccaaaaatgctttcggagtagacgccagcagcaaaatcgatggtatcgaactggccatgaaaacgattctcgaagaaactgaacgcgcacgccgcttcggattcaccgaaactgaatatgaccgtgcccgtgccaactatctgcaacgcgtagaatctgcttacaatgaacgcgaaaagatgaaaaacgacacttatgtcaacgaatacatcagtaacttccttgacaatgaaccgatgccgggcattgaatacgaatatgcaatgatgaatcagctggctccaaacattccggtagcggctatcaatcaagtgatgcaacagctgatcactgacaacaatcaggtagtactgttggcaggtccggagaaggaaggtgtaaaatacccgacgaaagaagaaatcgctgctttgctgaaacaaatgaaatctttcgatctgaagccttacgaagacaaagtttctaacgaaccattgctgaaagaagagccgaaaggcggaaagatcgtttctgaaaaagccggagatatttacggaacaacaaaacttgttctgtccaacggtgtgaaagtatatatcaaaacaaccgactacaaagctgaccagattctgatgaaaggtaccagtcttggtggtagcagccagttccccgacaaagagattctgaatatctctcaaatcaacagcgtagcaatggttggtggtatcggtaacttcagcaaagtagatttgagtaaagcacttgcaggcaaacgtgcttctgtaggagccggtgtgagcgcaacaacagaaacggtttccggcagttgttctccgaaggactttgaaacaatgatgcagctgacttatctgactttcactgctccccgcaaggacaacgaagcattcgaatcatacaagaaccgcatgaaagccgaattgcagaatgctgacgctaatccgatgaccgcattcagtgatacagtctcttatgcattgtacggcaatcacccacgttctttcagcatgaaagaaaacatggtggacaagatcgactatgaccgtgtaatggaaatgtacaaagaccgtttcaaagatgcgagcgactttacattctactttgtaggaaacattgatgttgagaaaatgaaaccgatgatcgccaaatatctgggtggtctgccatctatcaatcgcaaagagactttcaaagatacgaagatggaaatccgcaaaggtcaatacaagaacgagtttgccaagaaacaagaaacaccgatggcaaccatcatgttcctgttcaacggtacttgcaaatatgatttacgcaacaaccttactctcagcatcctcgatcaggcattggatatggtttacaccgcagaaatccgtgagaaagaaggcggtacttatggcgtaagctgcagcggaagcctcaccaaatatccgaaagaacaactcgtgcttcagattgtattccagaccgatccggccaagaaagacaaactatcgggcatcgtcatcgaacagttggaaaaaatggccaaagaaggtccgtctgccgaacacatgcagaagatcaaagagtatatgctgaaaaaatacaaagacgcccaaaaggaaaacggctactggctgggcaatctggatgagtatttctacacaggtatcgattatacaaaagactatgaaacgttggtcaacagcatcacagcaaaagatgtacaggaattccttgccaagctgatgaaacagaacaacgaaatccaagtcatcatgaccgtacctgaagaagaagctaaataaacttttatagcataccaacagtatgatgatatttaacgaattacgcaaacatggacggctcgcctccaaacggcatccgatgtatgaaaagaacaaagttgccaaaatattcggatatatcggggttgctttttgggcaggatacctgatattcttcggtacgacgtttgcattcggttttgcagatatggttcccaaccgggaaccatatcatgtaatgaatgccgttgccctgatatttattctggcacttgacttcctcttgcgtattccgttccaaaagacaccgacgcaggaggtaaaaccttacctcctgttgccggttaaacgaaatcggatcatcgatttcctgcttatccgttcgggacttagtctgttcaacctgttctggttgtttatgttcgtccccttttccttcattaccattaccaaatatttcggtatctcaggtgtactcacctatctcataggcatctggcttttgatcgttgccaacaattactggtacttgttatgtcgcacactaatcaatgaacgtatttggtgggtgctgctccccatcgctttctacggtggactgggctgccttgcctttattcccgaagacagtcccctgttctacttctttatggacctgggcgacggatatatcaacgggaatattctctgtttcctcggtaccattcttgtcatagccatcttatggctgattaaccgcaaaatcatgtccggcctcatctacgccgaattggcaaaagtagatgatacccgcatcaagcatgtttcagaatacaaattcttcgagcgatacggagaagttggtgaatatatgcggttggaattaaaaatgcttttgcgcaaccggcgttgcaaaggtgcattgcgcaatgttctccttgtagtcatcgccttctcctgcctgttgagcttttcaagcctttatgacacgagcaccatgactacctttatctgtgtttacaactttgccgtattcggcatgatcatcctttcgcaactcatgtccttcgaaggcaattacatcgatggactaatgtcccgcaaagaatccatcatgagtctgctgaaagcaaaatattatatctatactatcggcgagatcgtcccatttgtcctgatgattcccgccattgtaatggataaagttcccttactgggtatctttgcctggttcttctataccaccggttttatctatttttgtttcttccaactggctgtttacaataagcagaccgtagcactgaacgagaaagtgacaagccgccagaccaacagcgccatacaaatggttgtcaacttcggagctttcggtatcccgttgatcctgtattctgtgttgaatgcgtttctgggtgaaacggccgcctactctatcctgttcgccatcgggcttggattcacactgacttctccgctttggatcagaaacgtctataagcgtttcatgaaacggagatacgagaatatggaaggcttcagagacagtcgccaataagagatttacgattgaaccgattaatcatttacgataaaaataccaagacaatgataagcatcaataatcttcaaaagaaattcggcgaaaagttagccgtgaacatagatcactatgaaatcaatcaaggcgatatgctcggattggtaggaaacaacggtgccggtaaaacaacacttttccggttgatgctcgacttactgaaagcggataatgggaatgtcgtcattaacgaaattgacgtcagtcaaagtgaagactggaaaaacttcacaggtgctttcattgacgatggatttctgatagactaccttaccccggaagagtatttctattttatcgggaaaatgtacggactgaaaaaagaagaggtggacgaacgccttctgccgttcgaacgtctgatgagcggagaagtgatcggacaaaagaaactgatccgtaactactcagccggtaataaacagaaaatcggcatcatctccgccatgcttcattatcctcagttgctgatactcgacgaaccgttcaacttcctcgatcccagttcgcaatccattatcaaacatatgctcaaaaagtacagcgaagagcataatgcaactgtaatcatttccagccacaatctgaatcatacgatagatgtatgtccgcgtattgccctgctggagaatggcgtcatcatccgggatattatgaatgagaataattcagctgaaaaagaactggaagactacttcaatgtagaagaataaagttacttataattttacgatatacgaaaagaaagatagccgatgggagtgaacttcaaactaatcttcatactgacaggactgatctttatccttagttcctgccgcacgtctgctccccgtctggattaccaggcactggcacgcgcctccatcctgctgggcgtggacatcaatatggaagataaccacaaactctatctggaatcggccgaatggattggtgttccttatcgtggaggcggtgattcaaaacgcggtaccgactgttcgggactcacctaccagatataccggaaagtataccgtactcaggttccgcgaaataccgaagacctgagaaaagaaagtaccaaagtcgccaaacggaatttgcgagaaggcgatctggtattcttcagcagtagccgttcccgaaaaaaggtagctcacgtaggtatctatctcaaaaatgggaaattcattcatgccagtaccagcaaaggagtgattgtcagtcgactgagcgaagactattacaccagacactggatatccggaggaagaatacgctgattatcaacttaaaaacatatagaatcatgaaatcgtttattggagcagtcatatttatctgcgtagcgttaagcgcaaacgcacagcttttatggaaagtatctggtaacggacttagcagcccttcatacattatggggactcaccatctcgctccgttgagtgtcaaagacggcattaccggactacagaaagcgatggatgaaacacaacaggtatatggagaactgaaaatgtcggatatccagtctccggccaccatccagaagatgcagaaaatgatgatgatagaaagcgatacgactctgactaccctcctctcaccggaagattacgaaaccgctaataaattctgcaaggagaacctgatgatggacctcaacatggcacccaaaatcaaaccggctttcttactgaacaacatagcagtagtggcgtacatcaagcacatcggaaactataatccgcaagaacagctcgatacttatttccagactcaggcaacacaaaaaggaaaaaaagtggatggactggaaactccggatttccagtttaacctgctatacaatggaatttccctgcaacgccaagcccaactgctcatgtgtaccctcaataacatcgacaaagaggtggaaagcctcaaaagactgacagatgcctacatgaaacaagatttggaaaccatgttgaaaatcaacgaagagcgtaaaggaaatcaatgtgatgcacttcccacagaagaagatgccctaatttacgaccgcaataaaacatgggcacagaaactaccggctatcatgaaagccgctcctaccttcgttgcagtcggcgctttgcacctgccgggtaataaaggcttattaagcttactgaaaaaacagggatatacagtagaagcagtaaaataatgaattataaaacttatttattcgatttcgactatacactagccgattcatcacggggtatcgttacttgtttcagaaatgtacttaatcgtcaccaatatacgaatgtcactgacgaagcgatcaaacgtaccattggtaaaacattggaagaatctttcagcatactgaccggagtcaccgactgggaacagctcaccgcttttcgacaagagtacagactggaagcggatgttcacatgaacgtgaatacccgcctttttcctgatacactctctactctgaaagaactaaaagagcgaggtgcccgcatcggcattatctctactaaataccgtttccgtatacttagttttctggatgagtatctgccggaaaactttctcgacatagtggtaggcggagaagatgtacaagctgccaagccttcaccggaaggaataaaattcgctctcgaacacttgggcaggactccgcaagaaaccttatacatcggagacagtactgtggatgccgaaacagcacaaaatgcgggagtagattttgcaggtgtccttaatggaatgactaccgctgacgaactcagagcatatccgcaccggtttattatggagaatttatccggtttgctatatatctgattatcttctgttacaacagcaaaaaaataaaggaaatatttgtctgaaacaaataaaagaagtacttttgtgcccgattattccgcaacgggttcgataaagagctctttaagtgattaaagaccacccgccggagctaacttatacattatatataagatgtacgcaattgtagaaattaacggtcagcaatttaaagcagaagctggtcagaaactgttcgttcaccacattgaaggtgcagaaaacggttcaactgtagaatttgaaaaagttcttttagtagacaaagacggaaacgtaactgtaggtgctccgactgtagaaggtgctaaagttgtttgccaggttatttcaaacttggttaaaggtgacaaagttcttgtattccacaagaaaagaagaaaaggttacagaaaactgaacggtcaccgtcagcagttcacagagttaacaatcacagaagtagtagcttaatcatttaaaaagtaagaagaaatggcacataaaaaaggtgtcggtagttctaagaacggccgcgaatcacatagcaaaagattaggcgttaagatatttggtggtgaagcttgcaaagcaggtaatattatcattcgtcaaagaggtactgaattccatccgggtgaaaacatcggaatgggtaaagaccacactcttttcgctttagtagatggtacagttaaatttaaagtaggtagagaagacagaagatatgtttctatcatccctgctgaagcaacagaagcataacctgtacaactgaaaatattcaagaaaaggagatgtaatccaaaggattgcttctcctttctttttttatgcagattttcattgctcgcttattcgttttttctttatctttgtagccttaataaagaaagttcataaaaagtatagatatgcttaccattaaacaaattacagaaaatacagaagcggtactccgcggactggaaaaaaagcatttcaagaatgcaaaagagacgattgacgaagtcatcgccctcaacgacaagagacgtactacgcaaaacctattagataagaacctggcagaggttaattcactttcccgcacgatcggtcagctgatgaaagaaggaaagaaagaagaagccgaagctgcacgtgcacgtgttgccgaactgaaagaaagcaacaaagcgctggacgctaccatgacacaggctgctacagacatgcagaatgtactttatacgatccccaacattccttatgacagcgtacccgaaggcgtaggtgccgaagacaatgtcgtagaaaagatgggaggcatggaaacagaacttcccaaagatgcactgcctcactgggaactggctaaaaaatacgatttaatcgatttcgacctaggtgtaaagattacaggtgcaggcttccccgtatacaaaggaaaaggtgcccaactgcaacgtgccctgatcaacttcttcctggacgaagcacgcaaatccggatatactgaaatcatgccgccgacagtagtcaatgccgcttcaggttatggtacaggccagcttcccgacaaagaaggacagatgtatcattgcgaagtagatgatctctatctgatcccgacagccgaagtacctgtcactaacatctaccgtgatgttatcctggaagaaaaacagttgccgattatgaactgtgcatacacacaatgtttccgtcgcgaagccggttcttacggtaaagacgtacgcgggctgaaccgtctgcacgaattctccaaagtagaattagtgcgtatcgacaagccggaacattctaaagaatcccaccagcaaatgcttgaccacgtagaaggcctgttgcagaaactggaacttccataccgtatactccgcctttgtggtggtgatatgagctttactgctgcgctttgtttcgacttcgaagtatactccgaagcacagaaacgctggctggaagtaagttccgtatctaacttcgacacttaccaggccaaccggctgaaatgccgctaccgtagtgcagaaaagaaaacagaactctgccatacgttaaatggatcagcactggcactaccacgtatcgtcgccgctttattggaaaacaatcaaacccccgaaggaattagaattcctaaagcattggttccatactgcggtttcgacatgatagactaagaaactttctactcctgtaaggatgagatatctctgccccttacaggagtttcctttattaacctttaacacatttacccccatgacaaaaaacacaaaaagtttcgtattgccattggcattcattggcgttatgttcttttcactgggcttcgcccttggtatcaactcagtattagtccccgtattgaagggatcactggaaatcagttcggccgaatcatatctgatcattgccgccactttcatcccgttccttatttttggttatccggcaggccttacaatcaaaaaaatcggatacaaacgaacaatggtcctttcattccttatgtttgccatagccttcggacttttcataccatcggcaagttatgaaagttttcctctgtttttattggcttcctttatcagcggaagtgccaacgcttatctgcaagctgctgtaaacccgtatatcacgattctgggaccgatagacagtgctgccaaacgtatcagcattatgggtatatgcaacaaactcgcatggccgattcctcctttattcctggctttcctaatcggaaaagaagtgaccgatattacagtagctgacctgtttctgccattctacgttattatcgccgcattcatcgcactaggtattatcgcatacatggctcccctaccggaagtcaaagccgtcggtgaagacgacagcgaagaggcagccgaagcctgtccgtacgccgcaaagaaaacctccatctggcaattcccgcatttattattaggatgtcttgctctcttcttatatgtaggtgtagaaaccgtatcactgggtacattagtagattatgccaccagccttcatttggaaaatgcagcaatgtatgcctggattgccccgataggcattgtgatcggttacatctgcggcatcatcttcatccctaaatatatgagccaggctacagcactgaagatttgttcagtgctggctatcatcggttccgtactagtagtacttacacctgccgatatatccatctatttcatctcatttatggcattgggatgttctttaatgtggcctgccctatggcctttggctatggcagatttaggaaagttcaccaaatccggttcatctcttctgatcatggcaatggcaggcggtgctgttattccgaccttatttggctatctgaaagacatttccgatattcagaaagcatattggatttgccttccctgcttcctgtttattctatattatggggtagccggatacaaaatcagaacgaaataaataaagatattcacatggatatggaaagtcactcatcaaaagagtgacttttctttttatatttcgtaaataagccgtatctttgccgaaatttataacattctgatagcagttacgtaataataccaacaaattaattagataatgaacaaaatcattagcaaagaacgcttttctgagaaagtgtttaaacttgaaattgaagctcctttaattgctaaatcccgcaaagccggccacttcgtcattgtacgtgtaggcgacaagggagaacgtatgcctctgacgattgccggttctgatttgaagaaaggcaccatcactctggtgatacaggaagtcgggctctcctctacccgtctttgtgaattgaacgaaggtgattatatcactgatgtagtaggtccgctcggacaagctactcatattgagaatttcggaacagttgtttgtgctggtggtggtgtaggtgttgctccgatgcttcctatcgtacaggctttgaaagctgccggaaacagagtgatcactgtattggcaggacgtaacaaagaccttatcattctggaaaaagaaatgcgcgaaagctccgatgaggtgattattatgacggacgatggctcttacgggcgtaaaggtctggtaaccgaaggcgtggaagaagtcatcaaacgtgaaaaggtagataaatgcttcgccatcggccctgctatcatgatgaagttcgtttgtctgctgacaaagaaatatgagattcctaccgacgtttcattaaataccatcatggtagacggaaccggcatgtgtggtgcttgccgtatcacggtaggaggaaaaacgaagttcgtttgtgttgacggtcccgaattcgacggtcatcaggtggactttgatgaaatgctgaaacgtatgggtgcgttcaaaaaaatagagcgtgaagagatgaacaaactccagcccgaatgtgaagcaacgaaagagatagatgagaaaagccgcaacgcagcctggagacaggaactgcgcaaatcgatgaaaccgaaagaacgtacagctattccacgtgtcgagatgaacgaactcgatgccgaataccgttcacatagccgcaaggaagaagtaaaccagggtctgaccgctgagcaagctgttacagaagccaagcgttgtctggactgcgctaaccctggatgtatggaagggtgtccggtaggcatcgacattccgcgcttcattaagaacattgagcgtggcgaattcctcgaagcagccaaaacactgaaagagacaagtgcgcttccggctgtatgcggtcgtgtctgcccacaggaaaagcaatgcgaatccaaatgtatacacttgaagatgaatgaaaaaccggtagctatcggttatctggaacgcttcgctgctgacttcgaacgtgaaagcggacaaatttcagtacctgtcattgccgaaaagaacggcatcaaagtggcggtgatcggttcgggtcctgccggattatcattcgcaggtgatatggcaaaatacggttatgatgtaacagtattcgaggcactccacgaaatcggcggtgtattaaaatatggtattccggaattccgtctgccaaacaagattgtagatgtagaaatagacaacctcgttaaaatgggcgttactttcatcaaagactgcattgtaggaaaaacaatcagtgtggaagatttgaaggaagaaggttttaaaggaatatttgtcgcttccggtgccggtttgcctaactttatgaatataccgggcgaaaactcgatcaatatcatgtcttccaacgaatacctcactcgtgtcaatctaatggatgctgcgagcgaagactctgacactccggtagctttcggcaaaaatgtggctgtcatcggtggtggtaatactgctatggactctgtccgtacagccaaacgcctgggtgctgaacgtgctatgatcatctaccgccgttcggaagaagaaatgcctgcacgtatcgaggaagtgaagcatgccaaagaagaaggagtcgaattcctgacattgcacaatccgattgaatatattgccgacgaacaaggttgcgtgaaacaggtcattctccagaagatggaattaggagagccggatgcttccggacgtcgcagtcctgtagccattccgggagctacggaaacaatcgatatcgatctggccatcgtcagtgtcggtgtatctccgaacccgattgttccgagttccattaaaggactggaattaggacgcaaaggaaccattgccgtagatgacaacatggaatcatctattccgatgatctatgccggcggagacattgtgcgcggaggagctaccgtaatccttgccatgggagatggccgtaaagccgccgctgccatgaatgaacaactgcaaagcaagtaaaaggacaagcttattataacagaaagccccgtctgctgaatgcaaacggggttttcttatcacaagatacttcttacttcactacgctattcgtcgcagggtccgggaaaatcacggtcggtttaaacgacttcgcttcctcaaaatccatcaatgcgtacgacatgataatcacaatatcatccggttgcaccttgcgggcggcagcaccgttcagacaaatcttaccggaaccgcgttcacctttgataatgtaggtttcaaagcgttcgccattgttgttatcagcgatgtacactttttctcccggaatcatgttggcagcatccagcaggtcttcgtcaatcgtgatactacccatgtagttcaaatttgcctctgtgacacgtgcacaatgaattttcgacttcaacacttcaatcatcataaggtttcgtctttttttaatttagatttctttatacttgatattatcaatcagtctgacctctccgcagaacactgtgatacagcctactacatacagagaatcctcccaactgcttaccttttgcagcgtgtttccgtcaacgatttcaaaatactccaaacgcaatcccggagcatcctctatcgcttcttctaccatcttctgcgtctcactcactgtatgagatgctgcaaaggtacgacttttaaataatgtctgagaaatatttaaagcattttcacgttctcgtgctgataaacgtttattccgactgctcagagccaatccgtcctcttcacgaacgataggacaacctacaatttccagtttataatccatctgacgaaccatctcccgaataatcgccagttgctggaaatctttctctccgaaataagcacgatccggttgcaccgcgtcaaacaacttgctgacaatctggcaaactccgttgaaatgtcccggacggaaagccccttccatcaccgtatccaacggagcatagctgaattcacgcgtatccggctgtggatacatctcttctaccgaaggagcaaaggcaaatgctgccccgcaatcttccaacaagcggcagtcagcatccaatgtacgcggatactttgctaaatcgtttttatcgttaaactgagtgggatttacaaaaacactcactactgttacaccattctcacttacgctgcgctttaccagtgatgcgtgtcctgcatgtaaagcacccattgtgggtaccagtcctaccttcttaccctgggctctcagtgccgtcaattcggcctgtaagtccttgatagtgtgtattactttcatttttgttaattggtttatgttttggtcgtttgcaaaaactctgcaaaataaactaatatttgccacataaagaaagaatatggtatttaaagttccttttttttgctatctttgcagaatattatagtgaactattgttattatgacaaaggcgaataaagttttatttattactcaagagattacaccttacgtttcagaatccgaaatggccaatataggtagaaaccttccacaggcaatacaagaaaaaggccgtgaaatcaggacatttatgcctaaatggggaaacattaacgaacgcagaaatcaactgcatgaagtaattcgcctctccggtatgaacctgatcatcgacgatactgatcacccccttattataaaagttgcttctattcaatccgcacgtatgcaggtatatttcatcgataatgatgattatttccagaatcgcttgcagacagcggacgaaaatggtgtggaatacgatgacaacgacagtcgtgctatcttttatgcacgcggtgtgctggaaacagtgaagaagcttcgctggtgtcccgacgttatccactgtcacggatggatgacggcattggctcctctttatattaagaaggcctacaaggacgaaccatcgttccgtgatgccaaagttgtattctcggtatatgaagatgatttcaagaatacgctcagtgaagattttgcaaccaaactgatgttgaaaggcatcaccaagaaggatttggctggtttgaaggaaccggtagactatgcggcactttgtaaacttgccgttgattattctgacggaatcatacaaaacagcgcaaaggtagacgaatcaatcattgagtacgcccgccaatcaggcaaactggtacttgattatcaggatccggaaaactacgcaaacgcttgcaacgaattctacgatcaggtatgggaaaccactacaaataaagaagaagaataaaaatctagatacgacaatcatgaaagcaaaatatgccttgatagctttactggcaatcacatttttcggatgcgatgataatacaggcggactgggattaggaatgttcccgggcaatgaccaaaatatcaaaggaaagttatccacgtttgatgtaactactgaatctgttaagacaggtgacatttatgcgaaaactaacatcggttatattggcaaattcactgatgaaacatttggcacttatcaggctggattcttggctcagctaaattgtccggatggactaacttttcctgaaccatacaaagaagttacagatgcaagtggtaatgttatttcagccacaggaagaatggttgtcgatgataaagatccagaaaataaagatgttacttttataaaagacggaaatcaaatcataggaaacatacgtgcagtcgaactctacctgtggtatgacagctactttggagactcattgacagcttgtagattaagtgtatatgaactgggaggcaatgggaaagagacattaaatcttgataatgcttactataccgatattaaccctgaggatttttacgatagtcagaatatattaggaaccaaagcatatacagccgtagatctttcagtaaaagattctattcgtaacctaagcacatatgttccaagtgtgcatattgctttcaaagaggatatagcaacaagagtaggtggaaatattttaactgcggcaagaaaagctaaaaatgctgataaggaattcaatagccaattattcagagaagcttttcaaggaatctacgttaagagcgactatggtgatggaactgtactctatatagatcagccacaaatgaatgtagtatacaaatgctatgcaacagattctattaccggaaaaaaattacagaagaaagacggaagtggtaaggactctacttattactcttatcgtgtgtttgctacaactcgtgaagtaatccaagccaatcaattaaagaatgatcccgaaaggatagatgcattaattaaggaagataaaaacacttatttaaagagtccggcaggtattttcaccgaagctacactacccatttcagatatacaaaatgaattgacaggcgataccttaaatgcagtaaaactgacattcactaattacaatcaaacaggtgataagaagtttggtatggctataccatctactgtaatgcttgtacgtaagaaattccaggatagcttctttaaagacaataagctgagcgatggtgtatcttcttatctaacttcacacacaagtagcacgaaccaatatgtattcagcaacatcaccaaattggtaaatgcttgtattgcagaaaaggaagaggctaaaaagaatgctggtagttcatgggatgaaactaaatggttacaagaaaaccctgattggaacaaagtagtccttatacctgtacttgtgacttatgactcttcaaatactacaactggtcaagctaatattattagaatacaacatgatttaaaaccaggttatgtacggctgaaaggtggaagtctaggcaaaacaaatcctgattacaagttgaaacttgaagttatttctacagacttcggattaacaactaagtcaaactaaaaagatatataaaataaacagcgcgggttacttcggtaattcgcgctgtttttttatatgtacctgtaccttccaatatataaaaaacaaccgtgaggtgattcccatctccccacggttacaaccagttaatttattattatcttattcttctttctttgcagtagctttcttacgagtagctttagctaccggttcttttttcgcagctactttcttgggagcttttacagctcctttttcagcttttgcctgccatttggttacttccttttgcagttcggctatctcctcaccctgattcttaatagtagtcagcagagagttgagctcttcattatctacgtcaacaggatacagtgaatctactcgtttgataaagtcgcccaagatattcatgtagttagtgaaggcatcgtaaggagagtcataaataccacggttcagccagatacctgtattcttggtagtcatgaaacggaaattgttgctggcttgcagataatcccagtcctgcttgatacgacggtcgtcacacagatgaacacgttctgctacgctatacaacttgttgaaagcctcacgttgcaggatattacccagccaactgcttgtatctctttcttcgtccacccatgacattgggtaaggaacatccagctgagatacagatttcaatttagatacaatctctgtcggagtagagaacgtgataccctttgatttagcacattcgggcaatgctttcaggaattccaggatattggaagaaagcggctgagccatacccaatgcacttaattccataaagatattaatcacttgctcttcttgtggcaacgcatcaatccagttaatatacttatcagcaaataatggatattccggccattccgaattggagaaacgcaatcctatatcatcagaaagtttaaagtctctcaatagcaatttgaggctcggagcctgattacagtgatatacatagtgtgggctcttccatcccaatacatgttttgcaccttccgtcagcattcccttaaagcccatagaagctaccagtccaccgatttcatccgaataaatcaagctggagttgcggaacaccttcggttctttgccaaacatctgtttcattttatcacgctggcgaagcacttcttcacggaagcagtcttcgttagccaaagatgacaagccgtgtgaataaggttcgcaaaggaactcacaacagccggtatcattcaactggtgcagcaagtcaatcaccgccggagcatgaatttcaagttgctccaatgccacaccggaaatagaaagcgccactttgaaagctcctcccgagtttttcaccatctcaatcaacgtactgagagcaggtatataagatcgttcggcaacctcattcataccggtttcatttgcatagtcatcatagtaataatgatcggtgccgatatcgaaaaaacggtagcgtttcaagtgtataatctgatgtatttcgaaataaagacagatcgttctcatagtctatatcattttattgtttaccataatttttaataacctcatcatagataccgcgaactttatatcccacgttctcccatttaatctcatccacttctttcttaccctcttctttcaggtactcgtacatagccgggtaagtacagatagaataaatggcatccgccatagcgtgaatatcccagtagtccgttttaatacatttatccaaaatttcggcacagccggattgcttggatataatggaaggtacactacattgcatagcctccaacggagagataccgaatggctcagatacagaaggcataatgtatacatcactggctttcagcacttcgtacacctgctttcccttcataaaaccggggaaatggaaacggtccgcaataccgcgttcggctaccagacgaatcatctgatccatcatatcaccactaccggccattacgaaacggacattgcgcgtacggtgcaataccattgctgcagcctctacaaagtattccggtcctttctgcatggtaatacgtcccaggaaagtaacgaccttttcgctcggattcttttgaggaacaatatcctgtatctcttgtgacaaaggagaaacggcattatgcacagtagacaccttcttcgggtcctgaaaatacttatggatcacagtctgacgggtcagttcgctcacacacatgatgtggtcggcattgtccataccattcttctcaatggcatacactgtcggattgacattgccgcgactacggtcgaaatcagtagcatgcacatggatcaccaatggcttaccagatacttgcttggcatgtatccctgccggataagtcagccagtcatgagaatgaatgatatcaaactcctgctgacgtgctaccaccccggcaacgatcgaatagttattgatctcttcgtgcaggttgtccggataacgtccggagaactcgatgcatcccagatcattcgtattgagatagttgaagtcggcatagatatgatcgcgcaagtcatagaacaattgcggatccatataactgcctacgcgtcctttcacatagtcccaaccgacatttttccacactaccggcgtgctgttcatgccgataattcttaaaaagctctgatcttcgtctccccatggtttgggaatacagaatgtaatctccagatcatcctgctgagacattccttttgtcagaccataactggcagtccctaaccctcctaagatatgcggggggaactcccatccaaacattaaaactttcattttcgttcctcctctttttaataatacttagacagtagcttcagaatacgcagtacttcggcgacattcatggcaaacgatacagctccgcgtcctttaaaaggcggattaccatcgaaaagttcaggcagcgaactgatacaatgaattgtcagttcatcttcgagaccaataagctggcgttcaatgaacgacaggccactcatcttataaattcgcagataggcttccatatagaatcccatcagccaaggccaggctgtgccttggtggtaagcgtagtcacgctgtatctgaggaccaacatagttagggttatagcccccgctcttcggactcaaggtacggagtcccttgggggtgagcaactctttggttgcgatgtcgagcacttgcttcttttgtgcccggtccaacggagaataatcgaatgctacggcgaatatcatgttggggcgtacgctccagtccatcatatttccgtctacatagtcaagtaaatatccatattcgttgcggaacacttcgataaatgattttcccgtcacttccgcctgtgcgtcaagcgcatcggccaaaagaacgtttccatcttcacgaaccagatcggcaacgaaacgaagcgcattataccacaaagcattaaattctacgatatatcccgtacggggaatcaccggatgtccgtttacggtggagttcatccacgtaatcgccttatcggtgccattggcataaagcagaccgttttcatgcaggaagaggttctcatgtttccgctgacggataaattcgatgatatctttcagcagttcgccatatttctgacggcattgttcgcgagaggtctccttggcatactgttgcaaagcccatacggcccaaagcagtacatccggatgctccatctcgtaaatcttgtatcctgccggctcatcattgatgaagcttcgaatcgctttttccgctgtcttcatcacatcttcaaactgatccacctcctccagcgcaagtgtcagtcccggcaaggatataaacatatcgcgggcacggcacttgaaccacgggtaaccggcaaggatataatgttctccttcctgctggttgtggaactgatgggctgagtttttcagacagtgatagaagctatcgcgaggcgtacggtcagccacttcggcttcgaacgtctgcttcagtctgcgcggagtaacttcggaagtacccgcagagaaaacgatgctttctcctttctttatatccacttcaaaatatcccggaacatagaggtcttcattgaagtcgtagcctcgctcttgttctttcggatattcgaatccacgataccagtcgggctggaaatggaactcacaagccttgttcaactgcatgaacagttccggataaccgggatacatacaagtcttgataccattttccacaagctgataatcgcggcttgcctgcgcattctcgtgagtgtactctcgcacgctccggaaagcgaggaacggtcggaagcgcaaagtcgtcgccgaatgtgcgtccaacaaagtataacgaatcaggattctgttttcatgatgtacaaagattttttctttgcgtaacactactcctccaacacggtaagttgtcgccgggatatgctcacaatcgaattcacggatatacttatgtccattcggactaaagttgtttccctgatatttatgcaaccccaagttaaactcagcaccatgttgaattaccgtttcatcaagagaagatagcagcacatgattttcatcgtcgatattgggaacaggaattaccaacagtccgtgatatttgcgtgtgttacaatcaacaatcgttgtacaatgataagctcctgctttgttcgtccggagaatctccctttggagactttcttccagattcgtcatgagggtcttgtcaaatcgtaaataactcatagttgtgcattatttaaaggttaattattggtcactatattccttatatatatctattgctgttctgtatatataccagcctgagcattgtatatatagttgctcttggtttgctttatgatggtttgcaaatttactttgctatgttctatttggtcgattaaagcaaacaatttctctatttccattacaatgcgctgttgctcactaagaggtggtaaaggaaaagccatttgttctaaactgtattttggtaatccttcacgaccactacccgtaatcttcatagatttagcgaagtatgaagataaaactagcgcatggaaatattcaggttcaactaaaacagaacgcataatacaaacgtgttgactaacattaccacaattaaaatcagcaggaactacagcacatcttcccaatgaaccaccagtaatattcaacaacaagtcgttagcaagtacctccgtacctttcatcttctgatgaacttcttcggaaatatatttgatatcatcataaacaagcctgtcattatatacattttgcgagcggaaaaaagggatcccgttcgcagaatagttacttccccttggcgtgctaccggaacctatctttgagcatatttcttcaatcgttgtccacacccatgaattcggtatttcaaacggcacgttctcataatgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggtacaagttttccatgtatcgcaaggtcgagtatcttttgacgtaacgcttttgtatccatcgtcgtatttctgtttgtatttgtgcagttttggctgcacaaatactattcattttcttccagtttctttaattcctcattttcttcaaactcttcaatccattccttcaccttggcttgcaataaagccttgttggggagatagagttgataagcagaagcatagatgttagcatctttaggcaaggtgagttccactagtgcatcgttcttctccttacacagtagaataccaattgtcggcttttcaaagtcttgtttgacatagcggtcgtaatagttgacatacatctgcatctgtccgagatcttggtgagtaagtttgtctatcttcaaatctataagcacatagcattgtagcaaacgattgtaaaacaccaagtcaacaaagaaatgctgctcatcaaacgtgaaccttttctgccttgcttcaaataggaatcctttgccaagttctaataagaattgctgcatcttgttgataatggcattctccaatttagactctgagtaaactgcatcgggctttagaccaagaaactctaatgtgatgggattcttgatgatgtccgatggtttcccaatagtttgcccttctttagccaaccgcattacttcatctttgttacggctcaaagccaatctctcataaagacagcttcctacttgacggctaagttgtcttttagaccattgttgttgggtacattctatttcatagaaactgcgggcatccggattttccaccctcatcagtataagataatgagaccatgagagagcgaatgtcggttcagagatatgttcctctgccttcgaataatcggctaaccactggttagccttttggctcgactttggacaaccactggttagccctttagaaaagacaatataaaactgccgtatattcttaagcgttgaatacgaccatccatctcccaacctatcagtcagacgtttggagagttctttcagcaccgcctttccgtattcggctcttgtttctcccttttgctcatattctactatatattgtccgatatggaacttagtaaagacctcagcaatattgatagctgttgccacacgttcccttgcctgcgtgacaaggtcaacaacctttaagaacaggtcgtttatatctttatcatttgtgctaatatcttttcgcatagctcaattttcttcaatatttgcaagcagtttttcaagttcagtcaccgctctactgatggtctggctcttatccttgatgtctgccatcagttctgccaatgaacggtcgtccacctcaccacctggttttatccaagtaatgtcaagacttgttttgtctctggcaataatttcatctacaggatatttacgccaacgaccttgcggattattttctgcatcgtagatctctactcgattattgtagcaagaaacaaaatcatccaaatgatgccgttccagtttattggtggcaagcgtatgctttatgtctgtacggtaatcgtaaaaccatatttctttggttggttgtcctttgctgaaaaacaacacgttggcttttacgccttgcgcatagaaaatccctgtaggcaagcgcaagatagtatgcagattgaaatcctgcaataagcgtttgcgaatggtctcacctgctcctgcttcaaaaaggacattatcaggaagcaccactgccgcacgtcctcctgttttgagcataagcatcatgtgttggaggaagtttaactggttatttttggtctccacatagaaatccggacggttgatatccacagagcctgccggacgagttccaaaaggaggattggcaagtatcacatcaacaagagttgacggttctttttccaaagaatcctcacaaacaatcggactacggtctgtaccaataccatgcaaataaagattcatggaagcgagcgtcaccactaaaggcgtattatccacaccatgcaaagctttgtcacgcaagaaatcacgtttttctttacttgctgactgacctttcatataatcgtaagctgtaagtaagaatccacccgttccacaagccgggtcacaaaccgtttcacccatttgcggattgatacaatctaccattgcctgaataagtggacgaggagtaaaatactgtcctgcaccgcttttcttgtcttgcccgttcttttcaagaatgctttcgtagatagctcctttcacatcaccgtccataatgagccattgctcctcatcaatcatggtgatgacctttttcagataaacaggtttgtctatcttgttttgtgccttcgtataaatcgtacctatcagattgtccagctcactaagcaatttaagggtctcttcatattgttttaccaaatccagaccatcaaatgctatcaaatctgcccactgataaccagttggaatagccgactcttctccaaacatttctacattttcggcatccatcttcaagaataaaagataggtcagttgggtaatataatcagtgaatcctattccttgtccggcaagagtggttgccagattccatacttttttggtgagcgattgctcagttgaactatttgttgccattttttatgctgcttttcttaatactacaaatgtgtaaagggaatgaagtgcttcgtccactttctgcatattaccaaatgcccgaatcatttgtgccgcttgggttgcgtcatcctctcgaatatctctgaccgtacaagctccgttagaagcaatgtaatccacaatacgactgataacctctcgctgtttgtcagttatttcacgctgggtttgtcctaaccaaagattgaaaaactgtttagaggtagtaactacactatccaatcgttcgatttggcggaaagcaaagcgcacaagttgtatgatattggtcaatgcatcgctttcttctttggtagtggaacgccttaccgctttaggattgactatggcataagagttccaaagttgtttggaagtgaaatggttgtttgccattttgagtttgttttccaaatccttcaacatagaataggtgataggcgttccttcattattatatataatacgtagtgcttctatttcatcactgtgttctttgcagaactcctcgaaagcctctgtcgtactttttgcttcctcaatggaaaaccctttggagataagcgtatcttcacccggcatcaatgtattgacgaatccggctgcaagtataagaaggtatttccgagcatccgcatgattggcaagcggagcgactagccccttacgttcattgttaggctcatcagtgcttacaaacagtggaagaatgcctttctccagcgcatcgtatattctagcagaaagttccttcatgtcatcatgagacaaacggacaaactctttccgttgcgaatcatccgccttgttgtatattcgggcaagcgttgccgcaagccgtttgagatactcgtcaggaatatagccatgactaatacgttctaacaactcctttagagtaatcgtttttgttgtaggaccatcatctataggtgccactgtttgcgcatgctccgtcacgcctaccgcatcaaccaaataaaaacaatccttgctgaatgcgttcggggtaacattgcgaagttggtcatcaccaatagtacgcactccacgccctttcatctgaatatacaaaggcaatgactccacatcacgcatgaacatcaccacttccagtggctttacatctgttccagtggcaaccaacgtacaggtcacagcaatacggaaatccttgtcgttacggaattggcgtatcagttcgttactgtcgcctgccgaataagtaattttctgaacaaagcggtcgtcattccgtccgaacacctctttagctatctgtacgatatttgtagcgtgagcttcattgagagcaaatatcaaggttttgggcaaatagtccatattcggcttacgttgcgggtcattaaacaattctgtataaaccacatcccgataggtcgaaaggattaactttatctgtgccggattaataacactccgattaagttctttatttgtgtagtttttggtttccttactacttacagtcttgacctcacctgtatatcttgtttcttctttaaatttctcaccctctaatatagccccacccgtttccgtgacttgggtttttattctatatacccgacaatccacattcacaccatcaacgatactcttttctaatgtatagttgacaatgcgattgttattgaaaaaagccattgtttcgggaataggtgtcgcagtcaaacctaccaatcttgccgtatcaaaatactccaataccatgcgccagtttccataaatggagcgatggcactcatctataataatcatatcaaagtaatcgtgcggtaaattgggattgggaggcaaggttacttcctctgcaggttcgttctcatcatcgtcatcattatcctcaatagcttctcctttcaagaatgaaaacaaacgttgtattgtagaaataacgacgttactatcagaagggatagaaggtgagcgaaggcgattgaccgtaaagatagtattgaaagcgtctccattctctgtcagtcggaaagttccaaattctccctctgcctgttttccaagattatttcggtcgacaagaaacaacaccctacgcattggtgtataagaaagcattcggtaggcagcaagacaagcagtatatgttttgcctgctccggtagcaagaaccatcaatgcccgattttgcccagcacgaaaactcttttcaagttctgtcaccgcttcatactggcaatcacgaagccccttccttttcaatgtgggaagtccggcaaatgtatcctcaatccccagtttcttgaccaattcatgtggcgtaggaatagttattatctgtttgaaacaagaatcttgttcacggaaatcacagaagtatagttcttttccatttgaggtaaagataaaaggcaatggcttttgatatgcctgatagatatttgggacacttcgtgcatatagagctgcttgctcgcatacttttgaagcaaaaacgtctgtttcttcacgcttagcttcaagtactcctactgcttttccattaatgaaaaggaaataatcggcttcaagatttcctttcaataaaccttctcttatggctacagccgtaccagtaggttcataatcctccctattaactactttccaaccagcatcggcaaaccactggtctatctttattcttgctttttcttcaggagtcatattcttaataatatatattatcagaagtttatgctaaaaaacaaattgatattcaaagctataactttactctttcaataattgattcgctctaaggaccccctgtatttgcctaaaagatgcgcatacagttccgcattcactttgccgtaaatacaactctttataaaatcctcgtcgatacggtttccgtctatcgcattggaaacaacatcaataatctgtataatcttcggtttgttcatattacattattttatctacaaatatatatctatccaatcaaaaaacgcattatcagagctatgaaagcgaaacggagtgtagcggcaaagcgttttttggttctttttggggcgagtgccaaaaagaactcaccccgaaaggctgtccccctttcgggggatcttccttgtatcatgccacctgttccgcttcatctgcggccgtttcctcgctttctacggagatatccagtttcccggctatcatcttgacaattttcatagcgtcggccagtacgtttaaaatgaacttgggttcttcccggatcgcctttatccagcttttcagataagcggcgttttcagtgcgtatatgttcggctatcccgaaaaacattcctgccagggctgcggcgaactcggccgttaattcctccttgccgtattcctctgatccgaacgggtgcgcaagatcccggttcaatcgggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccgagtaatatttataggtcggtataacgttgtattcctgttgctgctcccggcttaacgccttgtattcctcaaaggttattttcttgcgtgtttccttgtggtacacgtagaaaaggaagtaatagaccggaaacgatttcgatcctttcagcacggagatcccagcctctttcgcctggttgaatgtcataaatacgggtgtctggtactggaatttctcgcaaaggaaaaggagtaaaaaggcgttgcctccggtgtacctgcgtcctgtgaggttctgcggaaagaaattgcgtgtattcgccgcaatggtgatccagggcttttgccaattgtcctctacctgctggatcttctcgatcatcaaatttgcaaactgttgcgctgccttgtcgaaataatcagttttcataactacgtcccccgttctttatcctggtgggtgagccagttctaaaggttgttatctctttttctatacctctaatatagcacttttatttgagatatgcaagtatttaaacaacatttaactaactatttatcagataattatatgaaaaagtagtattttagtatatactaaatttagtatttactacctgattttttccgatagtaaactccccacctcgcaccctctcccccccaaaaaaccttgcggatgcctaagattccgatgtttttgtatcaagacaacctcattttggtttttcggggctgtcggtgtggtcatcttgcgtttaccttgagttccgaggggtttttgtatgagaacaccccaaacgtttttttccatagcacaagttttttaggaaaaatactacctggctttagccaggctggagattttttctaaaagccgcttgcggctcaacttgggatatggaaaaaaacgtttgacctttgcagacaaaaaccccggtcaaggtaaacgcaaggcggccacgccggaaaaactaaaatacctctctcccctgaaagggggtttaaaaccgggttcgacaatcggctaccggagtacccggattgtgccgatcagtgaaaagtcaggcggcttttatccggctggcttcaccgaacggctctatccggaaatagcctaccttaatcgggtgagtgggtgtattcatgcgttagggattgcagtggaaagcccacagcctttaggcgaggacttggaggcggaaagcccgaccgtttacgggaacgcccaaatcctccaaaagaaaagcgtactaatatactaaaatactaaaagtagtaaatactacattccagggaacaagcctctattctttttaaaatcaatccagaaaagccataaaatccttgtataaacgagatatactccctatatttgcgtagtaatcccctgttgtccctgtcgcaagacaaactccagggttttgtttttatatactccccccctatacggtagcgtatggatctttttcctgaatcacctttttaatcttgaacagccgttctttggttagcggctttatagtttccggatcctcaccgtcgaatgtttccccgaagatcagatcgtccacctccaggccatgattaaaattctccctgatacagtcccttagcaaccaaaggtttttgaggttcacccaatcggccgttatgttcctgatccttctaaacatgattatcgcagtacgaaaataatgccccacatgatcgtaatcatggcaaacccgtttatccagataataaacatctatttcctggttttcttcatcctccgcgatccggcaaaggcagaacgggatctgctccagtttatcccattcgatatattccgttgatttcatattgtcattattataaatatcattacttgaccaatgatgcgattactttcgtaaactccgaaatatccccctccacgctggccttttccaacgctttcatatattcttttctacgctccaccggaacaaccgtccagttatagcctccagacgcaagcatggcgttcaagacgaaccgtcccattctcccgttcccgtccatataggggtgaatatacacgaaaaagaagtgtcccaagacagcccttaccgccgggtgcggctcattcttcaagagatcgaaaaggacgggcatagcgtccctgaccgctttcgggttcaacgggatatgttgcgatccccgtatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtatatcggcgatcgtccccctgacagcctggaacgcctggtaatacccacgtgccaccagtgcgtttttatgctccttatcttcttcctccggcttccagttcccgacacgcactttctcgatcagttccggggaaaccctatatccctcgatcgagagagaatgataagcgtcctccgaatacttttcatcgacggatctcaaatacccctccacgtcatcaatctttccaggggcttcgggaaacagttctacaaccttatccctcatgttctcccacatcaggcgcaagcgtgtgacgtaaggcgacacctcataaacaaggggcgttcgtggctgatcctcgaacggatcttcttctctcacgtcatacccgaacccccgcatcgtggaaacgatgctgtcggcgatttcgctgttcccgatgttccggaacgccccggctattcttccggcacgaagcgaagccccgtttttcgtcagtacctttaatatatcggcagcgtcccgtatcatggccaggcaggtgcgggctgcgatcttctccacctggaaatatctcggcgtggtatataccagggcttcggcaagcggatagagattaaggccgtattccggctctttatatacctgatccggaatctcgctttgaaacaccaaaagcgaggtatcatacatcagcttttgcgtgttgttatggcctttcggcgacttgataaccacctgtacgggcacggtcgttttccccgaatacagatccagcgactggtcggccgtcaagcaccattgttcccccagccggacatgcccgttatcacaaggtgtgaagtcgggatttatacgcttcaacagcttaattgctggctcttcattgggatcttgtggtactagcttaccatgtatggcaaggtcaagaattttgctcttggcttgtttgatggttgtttgtaaatcgtccttacctccttctataagttctatcaaagaaaaccatttctctatttctattacaatacgctgttgttcagcaaaaggtggaattggcaatagaaaagaacgtaatgtctccaatcctacagtcttttgtgctgtacctgtggcaaactcatcgcattgtcctttgaaataactactttttagcaggtgtaaaagatattcactcgtattcaaagtttttatcaacccaatgtgccgttgaaaacaaaatttacaatcaatgtttacaggtacaacaataccataagaacctgttacggtgaataacaagtctcctttttccggttttctatcaaatgaaattttctcataatattcttgtggaacaaaacgagtatttaagaaatttagttttccttttgcaacatctgaaataaccaaaaatgggatgccaatatctgacttaggcggtgcttgatgatcgccatcagtcacacttttaacataatcctccaatttgcaccatacccatgaactcggcacctcaaacggcacattctgataatgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttggtttctatttcttgtattctcttctgccgcaccgcttctttatatgcaagattattgcaccgatgcgaacagaagcgtgtcgttaacttttgggcatagaatgttgtgccacaccattcacataccttcttgattttcattttacttgttgccatattcgttacttttagaggtttatttctcttgtaatttctccattttgttcaactatcgtaaatcatagtcaaccatagtaaactttctccacgacctttccgacctaaaatcggagagtaacaagcgagcaacaaatacggtacaaaaatgagctgaaaaagccctataaacgataaccatcgcttataaggctaaaaagaaaggcgctcaaaatgaacgccttaataatcgttgatgatagatgctaattgttggtaaccaccacttactttccgatgcagcatattggactaattgtctaccaatgttttgaaaattaaacggtaggaaagtcttattttgctctttattcttcgctgaactgatgcaaagataatgcgtttttccggtacaggaaaacaaatgaaaagactttgataaaaaaggtggttttgggggcaaatttgccagctgtactatgaggttttcggaagattttgcatagcatttcatctagtgttatgcctatgtctatattgctggttgctcctccaagattgaacacggagtgactgatattgattgctggcgaaaagaaaaaatacccagtaggctaattttcttctctccctctatttgacttaactttattgcccgtgtatataataacggtcattaaagtcaagttgagagtggagacatatctttttcttttggcaagcaaaaattcagttattggaaattttcgaataactgaatttttaaagccccaacatatcatataatatacaaaaaggagcatttttagttactatatgatatattgaggctttagcgtattgctgacgagttcatgccttttacaagacaaggcacttgcccggattaaaaccattggcgatatgttcgttctcaaaaacatatcccatctgattgcaaactacctttgttccgtttatctcagcatcaatgttggtatgtgaatgcccataaatccatgcatcaatgcgactgtcggcaataagcctactcagttcagttgcaaatgcactattcaacacagaacctttatggtgagatgcaacaacctccaatgtgggaagatgatgcgttattaccacaatgtgtttggcggtggtttccaccagactttgcttgatgaaatccaaacagaagttgtgcatctgattgaattcctctgtttggagcaatttgccattatacattatctgccgaaagtcgttcatgcccttccacacaaaatactcgtcagatggagatattcgagaccacaaagtgctcatgataaagtcggtatcatcaatccgcactacttgattctgataatatcctacattgttcttgaacagccatttccattgcaatcccttgtccattacatcacaataattgtaatactcatggtttccgggcacaatgagcacctgacgataattcgcagatgcccatttccaaaagttagccaaaggcgcgaccttgtttttcaaatagaatatatctccggcaagaaccagaacatcgcccgtcgcaggcaattcattatgcttcaaccacctgctgttgtcgctgaactccaaatgcaggtcactcatatattgtatcttcataatctatttatgttattaactttttgtgtaaatcagttcataatactctgaatttgattcgttgtttatgatactgctacagaaagcaaatttgttgtacaagtattggtagtgttcgagttcttcttcttcaaaatttattctttcatagcattcgtctatctccttgctgattctaccgtacaaattgacatttgctttggatatacggacttccaacttggctatatcttctttatttttagcaatagcatttttgtaattatcaatctcttcttggtagaaataaagaatctcatcaagcaggcctttggttagtatactcggagaaggactccatggaagtatcgtcaactctcggcttggagtagtgctaagataaaacaatttacatcccaaagacttggtgacttgtttgttatattcatcaatctcacgattaactttcattaaatcttccttagataacttttgatattcctcatacgaaggatgctctttgtacttcaacaaaggtatctccttgcatcttaaataaatggtagtatattcactcattgttaatcttccttatcatttattcttattaaattgtcccacttgattttcaattattctcttcacttgttgaaatgaaacaggggtaaagttgttgttatctactcccacatcatattgcgttggatagagatactgaagccgggcagcatctattccggtgttgttctttcttgtgtgaacgtgtccgaatagttgccacacatctttatatcctccatcaaagcatagaaagggataatgattcaaatatatcctctgtttgccaatttctatgtgcatctgcattgccacatgttcaaatctgtcaatgtagccttggcgtatattcttcaaatcgtgattacccataatcagatatatctttccgttcaacctgtcaaggattttagtccattcggctgaaccgccaagacagaaatctcccagatgaaacacgatatcatcctgcccgactgtattattccaattggagattatagtctcattcatcacttccacatccttaaacggtctgttgcagaaacgaatgatattcccatgataaaaatgggtatcggatgtaaagaacaccttactgccatcaaatttatagttcatttctttgcaatttgtgtgcatcactgcacgttaataatccggttaccaacagcccatcagacggaaatggcagaagagcatcacaaaggcgactgtcacaaatgggcatacaaacaaaatagttggaaagcttggtaaggactctccaactattcagtttcttttctctcatagtacaataatgtactcgttatgttcgctggaaagtatttgctctacgaggttcaatgcatgaaacatgaacactcgacacggattcagtgcgtttgttgctctgaattgtggttgttattgaaaatatgttcattctgtttctttgcattgttaatgttttattgtcttaaaagcaatgcaaaattagcaaataaattccattctcacatcacttttcattaaattcttttgccaaaacactatgatataggattttatttttcaatcatgctcgcaaaccaaataaaatatgtagctttgcatttgacgcaatttataattgaatataatatggcgaatttgaactgtataaaggctgtattagctgagaaaggcattatgagtaagtggcttgctaaaactttgcagaaagatccggcaacggtgtcaaagtggtgcaacaatcattcgcaacctgatttatacacattggcgcggatagcagaagtgctggatgtggatattcacagattgatttgccatacaaaagaaaaatagaggatatgaaatatacaatagaagaaatacggcagatgcaggaaggtcagacttttgactgtaaaagtatcctcattgagcctaaacaccttgccactatcatagtcgctatggcgaatgcagatggtggaatgattgctgtgggtatatccgataagactcgcagaatagagggtgttaaccaggacaaggaacatctcaatgatatattgcggacacctttggacttttgtgttccatcagtttctgtcactacggattatgtgccttgtacggatgctgagggacgtgataaccgtgtattgttgatgcacatccctgcaagtccgcgacttcatgcgaatcaagccgatgaagtgttttggcgtgtaggagacaaatcacgcaaactgacttttgatgagcgtttgcaacttatgtacgacaaaggagaacgctattacgaggattccacagcatacgatgccacgcttgatgatatagatatggatgcagtcaaagcctacatgaaacggattggctatggcaagtctgcaatggaatatctgcaagagaacaaaggttttgtgacctataaaggtgatgtgccgcaagtcagtgcagcttgtatattgctttttggcaagcatcctcagacattctttcctcgtgcaagagtacgttttatcaaatatttcggcacagaggaaaaggtgggacgtgaaatgaatgtcatcaaagatgttactttcgatggtcgtattcttgaacagatccagaaaactgtcgaatatcttgaaacgcaggtcaaggagcattcctatctcggagaggacggcatcttcaaaaccgaccgcgaataccccaagtttgtaatacaagagatggtggtgaactccgtttgccatcgcgattacagtattaagggcacggaaattcagataaagatgttcgacgaccgtcttgtgttcgaaacaccaggcaagttgccgggcattgttcgcactgacaatattcgtcatacccatttctctcgcaatccgaaaattgcggaattcctcaaagcatacgactatgtaaaagagttcggtgagggtgtagatcgtatgtgccgtgagttgtcggcattgggtgtcaaagaaccgcaatacaatttagttgcctttatcatgaaagcaactgtctgtgcgaaggttttggaagaaagacaaggaactaaccatttcgaccagaagcgaccagaaagcgaccagaaaagcgaccagatgcgaattatccttgaattgataaagtcgaatcctaatataagtagaacagaactatctgaaaagacaggtcttcacgacagtagtgtaaaacgtcgcttaaaaacgcttgtagatgaaggcttgattcaacgtgttggtccagataaaggtgggcaatggaaagtgattggttctctttaaggaaatagaggatagaaataaattaactgtatcttttatagataagatgagaaatatcaagtttaatttttatttatgcctatatgagtaatttggattcattagtacttgagcctattgagcaacctttatcaaacaccacaaatatgttaagtaatgaagatagggttctttgtaatatgactccattacaaagactttatagtattgatgaagatacatatgaagaactggtgtgcgtatgggcatattcctgtttgggcaataaaggatatactgaagtataccgagtcggtcaggctggggataaagggcgtgatgttttggcatattatgatagggtaaaaggcgcatttgacttatatcaatgtaaacaatataaatcagcactaacctatagtgacctgtgtggagaaatgggtaaattattgatatatacttttaataacacctatccgataccacagaattattatattctttgtcctaaagatgttagtcagtctttcgttgatttgcttagtaataatggaaaaaatcttaaaattaagttgaaaaacgactgggaaactgtggtaaataaaaaagttggtactaactgggtagcattaaatgaggaattgtctacttatattgatgaatttgattttaatattgtaaagaaaatagggccgataaagtttattgatgagatacgtcaaagtccttattatttctattattttggaggtggatttaatatgattaaacgtactcctcttcaagtaccacattctccaataaacacagaacgtaattatattcagaatcttaatgatgcctattccgaacatgcgggttatattataaatgttatagatgatgataatgcggttgtaagtaaatatcgaaaacatttggatagagctagaatatcgttttatgaatcggaagaagtaaagattgcaagtagaaaatccactgctccagattctgatgaatttaatgatttagtaacatctatagaacgatatattggtaatgaactggatgatgattatcctgatggttttacaaaagtaaaatcagttgaaaaaaaggcaggaacttataatatgccgacatcaatgctgatttctcatttagtagatagtaatgtatgtgttggtgtgtgtcatcaactttcaaatgaaaatagaataaaatggactgtaaacgaataaagatacttgatggcgtcttggatgtctctttgagggtgttatttatattgtcggtatataataaatcgatggaaaaagaacgtattgttgtatacgactatgtgtcatgtaataatgattggaagaatcatcagtttacgtatgttggacttcaaaaaacaatcaatgattctttgcatctgctgttggctaaacaattaatagtttgcaaaataaatcaaaatgaaaatatgtatttgctgagtaatataggaaatgctttggttacagagttggcaacagaagtatatgcagtaaaactatataaagcaatacaccaaactgatatcatcttgcatgatattgcgaaagagcaattgctgtcatatattaatagccaaatttgagattcatgatgaataacaatggattatatataaaagagtttgaggctcgtggggaaaatgtatcaacatcgaagttgacttttcagaaagggtgtaatgttgttctaggaaaatctgacacaggaaaaacgacattatattcaataattgagtttgtattaggtaaaggaagtatagatttgaccttacctccagagggggatggttatacagatttcttacttgaaattcatacttacgatgaaagagtatatacattgaggagaagcataaattcaatgtctgtatatgtttctccatgtttgttaagtgaatatgatggacagcacaaagaaactgaatatagttgtcaaggttcttcaaatattagtttgtctgattttttgttgtcaatttctaatgtcccaaccatatattctaaatcttcggagagaaagaatccgacgaaaatatcatatccagctattcgtcacttatgtatgatagatgaaacaagagttgcagcaaaagacaaatctccattagtctataactctgttccgaatcagcaatgggttgagaaaaaccttattgcatatttgatgacaggcgttgatgatagtgaatttagaccaaatgaagatcctaaagataaaaaatctcgcataaatgggaaaattgagtatttgactcaaactcttaaagaggcagaattaaaattggaatctttgggcgatgttggatatatttcattaactgatgatagctttattgatgtttatagaaagaaattgtcagaggttgcttcggaggaggaagctttgtataataagcgagaacaaattttagaagaggttaggatatatgagacggaaaaaaagaagttacttcatcttatatcaaggctgaataatttaaaatctgattacgaagatgaaatgagtcggttgcaatttattaatgctggaaattctttggtgtctcagctgaaggatgtagattgtccattatgcggttcaacaatagcgcatcacatgattgccaatatttcatcatcagaatatgctgaagcaatacgaaatgaatacaatgaaatatattttaagcatcaagatctaaatgttttaatatcagaaaaggaaaaagagatagaatctatatctgctaatattgaagaatattatgccaagatacatatacctatgacttattacctactaccgtctcaccttattatatatcttcttatcaaatttataataacgcgctgcacgatgggctactccctgctgtttttcttccaaaggaactacatattccatcatcgctattttcttatggaagttgcgcacatccacaggcttgtcatataccaactcaaaaagagtcctcaactgggcagcggtaaatttacgtggaagcaactcaaacagcatagaaggattgaactccacaaactgacggatataggtcattgcctctttaataatcagattatggtcgaaagccaatgtcattacatctttcaaagcaatccaacaggcctgatgatcatccagattcttgtccagtgcccggtctattttcaccatcgacagataagcaattgtcacgatacgttcaacttttgactgcatagcccgttccagccagcgtacatcctttggattgctggttctgtttttagagccgaatgccttgaattgcatcaggtttacatttctgagccccgtcaattcatacagtacacgttgtgctgcttcatccaaatcttcatccatatagataaggctaccgggaagtttcatatcgtgatacacttcaccattatcttcgcccgcacgttttacaagtaacactttgagttgttctccgtcaaaaccaatcactacacagtctactgatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgtttgccaagggtgcttttttctgtatactttgcatatccttttctttaatacgatgcaaatataggggcgctttatgattcgaacaataacaaatgacatgctataaaacattgtttttcatagatatacatatcatacaatctacaatatgagtacttagtgttatcttctgaattacaatatgtattttacccgttccggcaacgagtaattgtataaagtacaaaaagcggaatgactctttattatcagcacttttcatattcaccctttgtcttctccggcaacggacttattgtatttcaaacgatatcccattttgtatcttgccgtttttattctatctttgccggataaatattaaaaaatctaaaatggaacgtcatcccgtcattttatccattgccggttccgattgttcgggaggagcgggcattcaggcagatatcaaaacaatctcggcattaggaggctatgcggcatctgctatcaccgccgtcactgtgcaaaacactctaggggtacgcgccgtccatgcaataccacccgaaattgtttgcggacaaatcgaagcggtgatggaggacttgcagcctgtcgctataaaaataggcatggttaacgatattcagatcgttcatgtcattgccgactgtatacggaaatattcaccggagcacatcatttatgacccggtgatggtatctaccagcggccggaagctgatgacaaatgaagccatcgaagagattaagaaagaacttttgccgcttgtcacattagtcacccccaatatcgatgaagcaaaggtgctgacaggcaagagcatccaaaatacacaggatatgctggaagctgccaaacaactctccgacagttatcagatccatatcctgatcaaaggcggacatctggaaggcgatcaaatgtgcgacctcttatattctccggatcacacctattatatatatgaagagaaaaagatagaaagtaaaaacctgcatgggaccgggtgtaccctctcctccgctattgcaagctatctggcaaaaggatattcgatgaaagaatccatccgtcacgctaaagaatacattactcatgccatcattgcaggcaaggacttgaatataggccatggcaacggacctctgtggcattttcccgactccattgcacaaatgtgtacattttgtgcggtcgtatcataaaaatctgtaactttgcacccgcatttaaaaatcaattaaataataaagatatgaaagcatttgtatttcccggtcaaggtgctcagttcgtaggaatgggtaaagacctgtatgaaaactcagctttagcaaaagaattgtttgaaaaagcaaatgatatcctcggatatcgcattacagatatcatgttcaatggtacagacgaagaccttcgtcagacaaaggttactcaacctgccgtattccttcactctgttatctctgctctttgtatgggcgatgatttcaaaccggaaatgacagccggacactcactcggtgagttctctgcattggtggctgccggtgccctgagctttgaagacggattgaaactggtttatgctcgtgcaatggctatgcaaaaagcttgcgaagcaactccttctacgatggccgctatcattgcattgccggatgaaaaggtagaagaaatctgtgcatctgttaatgcagaaggtgaagtttgcgtacctgccaactataactgcccgggacaaatcgtaatctccggttctgtaccaggcatcgaaaaagcctgcgaactgatgaaagctgccggtgcaaaacgtgctctcccattaaaagtaggtggtgctttccactctccgttgatggacccggctaaagttgagctggaagctgctatcaacgcaacagaaatccatactcccaaatgtccggtatatcagaatgtggatgcacttcctcatactgatcccgcagaaatcaaaaagaatctggttgcccagctgactgcttccgtacgttggactcagtctgttaagaatatggttgccgatggtgctactgattttacagaatgcggaccgggtgcagtattgcagggattgatcaagaaaatagatggtacagtaagcgctcacggcattgcataagcattcgtagatatactttaccttttctcaactatagagcgtgtcgactagtttgccgatacgctttttttatgcttattagtcaaacatgagacaattaatatgctgtaaaacacaccattagtcttctctacgagcaaacattccgaatctttcacttgttttcattataggaatcatttattcaaattcgcggaccatgaaaatacatgaatatcaagcaaaagaaattttctccaagtatgggatccctgttgaaaggcataccctatgtcgaacggctgccggcgcagttgccgcatacaagagaatgggctcggacagagtggttattaaagcacaagtgctgaccggcggacggggaaaagccggaggtgttaaactggtagataatacagaagatacctatcaggaagctaaaaacattctgggtatgagtattaaagggcttcctgtcaatcagatactggtcagcgaggcggttgatattgccgcagaatactatgtcagcttcaccattgacagaaacacacgctcggtcatccttatgatgagtgcgtccggtggtatggatatcgaagaagtagcccggcaatcaccggaaaaaatcattcgctatgctattgacccattcatcggtctgcctgattatctggcacgccgtttcgcattctcgctcttccctcacatagaacaagccggcagaatggccgctattctgcaagcactctacaaaattttcatggagaatgacgcatcgctggttgaagtaaatccattggctcttaccgccaaaggcatattgatggctattgacgccaaaattgtttttgacgataatgctctttaccgccatccggatgtactgagtttgtttgatcctacagaagaagaaaaagtagaagcggatgctaaaaacaaaggattcagctacgttcacatggatggaaatataggctgtatggtaaatggcgccggacttgctatggcaacaatggatatgataaaacttcatgggggaaatcctgccaacttccttgatattggcggtagttcgaaccctgtcaaggtggttgaagctatgaaacttctcttacaggacgagaaagtaaaggtcgtcctgataaacattttcggaggaatcacccgttgtgacgatgtagccatcggtcttattcaggcattcgatcagattaagagtgatatacctgtcattgtccggctcacaggaaccaatgagcatctcggacgtgatcttttacgcaaccatagccgttttcagatagctacaactatgcaggaagccgctttaatggctatcaaatcttaagatgaaatcacataaaaaatgaaggaacaatgagtatattaatagataaatccacccgtttgattgtacaaggtattaccggtagagacgggctttttcatgccaagaagatgaaagaatatggaacgaatgtcgttggcggcacttctccgggcaagggaggtacggaagtagacggtattccggtattcaatacgatgcatgaagctgtaaaacagacacaggctaatacttccatcatctttgtgccggcccgttttgcagcagataccattatggaagctgcggatgcaggcatccggctaatagtctgtatcgcagaaggtattccgaccctggatgtcatcaaagcacatcggtttgccgaacaaagaggggcaatgttggttggccccaactgtccgggacttatttctcccggagaaagtatggtaggaatccttccgggacaagtctttcagaaaggaaatgtcggtgtcatcagccgtagtggaacactcacttatgaaatagtatatcacttaacgactaatggtatgggacagtctactgcaatcggcatcggaggagatcctgtggtaggtctgcatttccttaaactactggaaatgttccagaatgatcctgaaacgaaagcaattgtgttaatcggagaaatcggaggaaacgcggaagaacaggctgctgaatatattcgcagtcatgtaaataagcctgtagtagcatttattgccggacagtctgctcctccgggaaaacagatgggccacgcaggagccattatctcgggaggttccggctcggcaaaagacaaaatagaggctttagaagctgccggcatacgagttgcacaagagccttcggatattcctaagttactgaaaagataaacagaaccacacggagaaatagagctttgggcttttgtttctccgtgtggttctattttatgtaccaatatatccccgcgatgataaagtaatatctgaaatttacattccctttttcacgcctaactttattaataaagcattcatcggataagcacagaaaaagccaaaaagcatagccagctgcatcataaaccaaaatatccatgtgtctttaggcaaaggctcattgacaaataaaacaaaataaacgattgccatccagccatacattccgatttgccaagacaacagagaaaagaaatctgctttaaaagcacgggacagtacctttcccaccgatatcctctccatctcccgaatagcatagaattgaaaataaactccgatgattaacgccaatataaaatcaagtacccagtttcctataagctgacttcctgcaacggttaccgggatataattagtgaaccactctcctattatatcagccaatgtgcagcctgctccacaatgtaaagccgataaagccacagactgccaatgaggatgtttcatggacatatctcccatcgacatatccatattcatgtctttcataccggacatatccattttcatttcaccacctcccatcttcatgggagcaccttgtccgaacttattataagcccataaagctaagtaacttccccacaatgcagtcaatatccatactgcattcattatcttcattgattgtggacgatgtgtcagatcgattgctatgtgaactgcaattccgatacctgaacagactaaaaacacggctaataaattgagcataattgtatatttaaaaagattttagactacaacagcccttatttataaatagttcatcccgtccatttttaaattcatcccatcgaactattctccttactgtttgtttataattttattaattaaatattgaattgtatgagcagacgtagtcaattagagcatgaagtatctgttgctcaggaaagaattaagaaggcagccaaagatacaccgaaagatatcataaagttatgggaacaagacttggtagacttggaacttgaactcaataacctggtagatgatgaagaagataataatgaagattaactaaaagagggtgcacttcattgtgaagtgcaccctcttttagttgtagtatttttataagcagaatgcttttattgcttatccacagtggaaatacttatgtaccagttccagcatttcttccggtttgccttccatgtcggcacgtaatgttttgtcctcataactacggagcttgcgtataataccgtcaatcatagccggactaaatacattatattgctcgaagacagcacgttgtttttgcaaacattcggcagatgccgcacaactatccggcaattgagccaatgctttcagcttgtcctcattctctttctgatggatatttacatttacatacgttctctttgcaatgtccaatgcctgttctatctcaaaaccatgacggcaggcaacagccagtcccgcaagcagctgatacaaatctgccgaaccatccggagaacgcatttctaccgtttgtttctggctggtatcaaaatgactttcgctttccaatggatttgccaaagtacacatatcggtcttggcagcccagcccaacggtacacgcaccaatacagaacggttgcgatctccccagcaaacattggtcggtgcttcctgatgaggaaccaaacggaagtaagaagtaggattggtatttccgaaggctgtaatagaaggagcaagttccatcattccggcgattgccttacgggctgtttccgacaatacaccgtctttcagcatctgattttgtccgtcctttacaatacgcatgtgaacatgtagacctgacccggcttttccagccgtaatcttaggcgcgaatgtcacattatacccatatctgtatcccaagttacgaatcacccatttggcaatcatcaattgatctgccgcatcttcggcatgaacaggcaggaactctatttcgttctgttcataaatcatgccatccaatgtaaaattcccaacctcggaatgaccatattttatctgcccacccgtctgagctatatatgacatacactgcgtacggaaatcgttaaacttagcatacggagcagattcatgataaccgcgttgatctgtagcctgaaacattcctgtatccggtgaaataacatagtattccagctcacccatcgcctgaaactccatacctgtgacatcagtaaatgctttacacgctttatgcaaagtatgttccggagaactttccaatggctcaccgtctttattgaagaaagaacaaagcatcgaaagtgtcggtatttctgcaaacggatcgacaaaagcggtacggaaacgaggcactacatacaggtcgctactccccgcctctataaaaggaaacaggctggaaccgtccacccgctctccacaagtaaggatcgcatccagataagccgcattattaattacaaaattcaatgttttcagtcgcccgtcagcagcaggatacatgaaattgaccatacggatattattcttctgaataaaagaaataatatctgccttagtaaactcggcggcaggcttttccaaagcagccaccagacagttaggattcattaaaagttcttgattcatcttctatcggtttgttgttagtgaaccaaaggtaagaaaaaaataaccgcagacaataaaaagagagataaattctttggactttaagaaatagtccggccaggattctgcagaaacgaaagaaggtgtgttgggatcaccaacacaccttctttttatatactgattgttattcagtcaattagttcttcggcaaagcctctttaactaccatcggacggcctacatattcagcaccattcaattctttgatagcgttagctgcttctgtatcatccggcatttcaataaaagcaaagccttttgatcttcttgtttcacgatctgtgattaatttaactgaagcaactgctccatactcttccattacgtttctcaagtctgattccttaacgttatagttaagatttccaatgtacaaattcataaaatacaaatataaaaaattaataatttcaataacaaagttgtaaatacattatgatagttatgaagataaatatatatcatcaaactatcataatgtcacatttatgtcagtatgtgcaaatttagccctgttcaaataatcattatgtcatctaaacacttcctttttatctttaactaagccttgaataatataaaaattatattagatataaataattagtatgaaaataggttataggagaatatgatacaattatgtgttacgtaaaaaagagaaaataaaataagttctgctagaactttgaaaattagctacattggaatgaaaactcaggagattcctatcaaaacaggaacaataagaattctgatgaaaccagatgcagaagttctggaggaagtagtggtaaccggtatgcaaaaaatggacaagcgccttttcacgggagctgcaacaaaacttgatgcagaaggcgtaaaacttaatggtatggcagatatcagccgtggtcttgaaggccgtgctgcgggtgtgtcagtccagaatgtatccggtacatttggtacagctcccaaaatccgcgttcgcggtgctacctccatttatggtagctccaaaccattatgggtagtggatggagttattatggaagacgctgtagaagtcagcgctgatcaactatcttcaggcgatgctgaaactctaattagttcggctattgctggtctgaacgcagatgatattgaaagctttcagattttgaaagacggctcagcaacctcaatctatggcgcacgtgcaatggcaggtgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttgttactacaaagaaaggtaaagctggagtcagtagaataagctataccggtgaatttactacccgtttagtaccaagctacaatgactttaacatcatgaactcgcaagatcagatgggagtatacaaagaaatgcaacagaaaggctggttaaatttcgctgaaacctcccgaactgcagaaagtggtgtatacggaaagatgtatcagttaattaacacatacgatcctactaccggacaatatgcgttattaaatactgacgaagctaaaaatgcctatctacgtgaagctgaaatgagaaataccgattggtttgacacacttttctctcccagtctaagtcagaatcattctgtaagtcttagctctggtacagaaaagtcatcgttctatgcttctttaagtgctatgcacgatccgggatggtacaagcaaagtggagttgatcgctatacagccaacttaaatatgaatcataatatcttaaagaacctaagcataaacttgatatcaagtgcttcttatcgtaagcaaaaagcaccgggaactttaggacaagacattgacctagtaaacggtcaggtaaaacgtgaatttgacatcaacccctattcatatgcattgaatacttcacgtacattagacccaaacacttattacaccagcaactatgctgatttcaacattctgaacgaactggacaacaattacatggaactgaacattgcagatttaaagttccaaggcgagttgaaatggaaaccaattaccggattagagctaagcgctttgggagccgtgaagtatcaatcaacttcacaggagcacaacattaaagaccagtcaaaccaggcatcggcttatcgtgcaggtctagatgacaagacaattatggaccgcaatccatttctttataagaacccagataatccatatgcactaccgatctctatcttaccggaaggtggtatttatcaacgtagagactataagatgctaggttacgacttccgagctacagctagttggaaccacgtatttaatgatatacatatcactaacttctttgcaggaacagaaatcaactctacagaccgatcaaagaattactatcaagggtggggtatgcaatactcaatgggcgaaataccctactatgtatatgaattcttcaaaaaaggtatcgaagacggcaataattactactcattgagtcagacccgtagccgtagtgccgccttcttcgccaatgctacctactcttataaaggtcgttatactgtgaatggaacagcccgctacgaaggtaccaaccgtatgggtaagagccgctcggcacgttggttacctacatggaacgtatcaggagcatggaatgcccatgaagaaaaattcttcagcaatttaacttctgttctttcacactttacactgaaagcatcttattcgttaacagccgaccgcggtccggcagacgtaacgaactcacaggctattataaccagctatagtccttatcgaccatttacttctatccaggagtccggattgtatattaaggaactagaaaatagcgaattaacttatgaaaagaagcacgagttgaatattggtgccgacatgggcttcttgaataaccgcattaatttagctgtagactggtacaaacgtaacaactacgacttgattggtatcgttaatacacaaggcgcaggtggacagatcctgaagtatgcaaatatcgcttcaatgaaatcacatggtattgaattcactttatcaactaagaatattaaaacaaaagatttcaactggaacaccgactttatattctctaatgcaaaaaatgaagtcactgatttgaaacaaaatgcgaatgtgatggagcttatttccggtaatggattcgctaaacaaggctatccggttcgtgggctattctctatcccatttgtaggtctcgacaaagatggtattccagtcattataaatgaaaagggcgaagcgactagtaccgatataaatttccaggaacgccaaaatactggtttcctgaagtatgaaggtccgactgatcctaccattacaggtagtttgggtaatatgttctcatacaaaggtttccgtttgaatttatttatcacttattcatttggaaatgttatccgtttaaatcccgtattcaaagcatattattcggatctaacggcaatgactcgtgaatttaaaaatcgatggacactccccggagacgaagcaaagactaatgttcctgctattttgagcaaacgtatgtacgacagcaatgaagacttgaagtatgcctacaatgcttacaattattcaacagaacgcattgcaaagggggattttatccgtctgaaagaaatctcactggcttatgacttccccaaagcatggatcaacccattgaagttaacagacctctcgctgaaagtccaagccaccaaccttttcttaatctatgcggatgataagctaaatggtcaggacccggaattctttaatgcaggtggtgttgcctcaccggttccccgccaatttactattactttaagactggggttataatttaaaataagaacgaatatgaagaaatacataataatggccagtgtggccgcgctcgcaatagggctctcatcgtgttctaatttcttagatgagcttcccgacaatcgtaccgagctgaatgaaaacaatgttggcaaaatattactttccgcctatcctactacagcaatctgtgagatgggggaaatgtcatcagacaatactgatgcttatccgaatcgcttttcttctttcaaccgtttgcaagaagatctctataagtgggcagactctgcagaacaagatcaggactctccccatgcactttgggaatcttgctatatggcaatctctgcctgcaacgaggttttgaaagtgattgaagacgcaggaaatccagcttctcttagcgctgaaaagggagaagccctagtatgtcgcgcctatgctcattttttacttgccaatatattttgtaacgcttatagcagccaagcaagttcagacttgggtatcccctacatgaaaacgatagagacaaccgtaagccctgattatcaacgcggaactctagaggaggtataccaaaatattgagaaagatctattggaaggtctagatctggttactgatatttatgcagtccccaaatatcactttacaaagaaagcagctcaagcttttgctgcacgcttttacttgtactatgtaaaatcggataaatccaattacactaaggtgatcgattacgcaacaaaagtattaggaagcaatccagccacctctgtacgcgactggaaatctttgggtgcactagacataaatggcagtgttcagccaaatgcttatgtagatgcaacgaatggcgctaacttattattggtcagtgcaggttcttattggggatatgttcatgcaccttatggactaggcgaaagatacgcccatggaccgaaagtaggcaatgagacatgcaattccgtcggtccttggggaagtgactattatatgggtgtttggagtaactcaagtgcactgccgaccaaaatcgttgttatgaaaataactcaatataaagaagtggttgacgcagtagccggaacaatcaacggacacatgatcaatgcagcatttactacagatgaaacattactctgtcgtgcagaagcttatgcgatgaaagaaatgtatccacaggcaattgctgatttaaatatatggcgagaagcatacacacgttctactaccccgcttaccacagaatctataaacgatttctacggaagcatggaatattacactcctactgaatctacagttaagaaaaaattgaaccccgactttactataacaaatgaaacacaggaaaatgtaatccactgcatacttcatgcacgacgtttaacaactttacatgaagggttacgctggcaggatattaaacgctacggtattactatctatcgtcgtttaatgaatgataatggtactattaccgtcacagataagctggaacccaatgatcctcgtcgagcaatacagataccgagcgatgttatttcagccggattaaaaccaaaccctagaactaaataaaaatcgataagttatgaaaaaatatataatatatacattgatcgttactatagccgtttttttaggctcatgtaataaagatgatattgataccaaacgcagtatatttgatcctactgaagtttatgagcccaacgagtttgacaaatggctacttgacaactatgtttacacttataatatccaggtgaaatatcgtctggatgacaatgaaacggatgtagaatatcatctggttccagccaagtatgacaacgcaattacattggctaagattgtaaaatttgtatggatggaagcttatgacgaaatatggggaattgacatgacccgtacgtatgtccctaaactactccaattcattggaaatgttgcttataccgagtcaggtatgatcctcggacaagccgaaggaggaatgaaagtaaccctgtttcgtgtaaatgaaatagataaaaacaatctcagtgtagctcaattaaatgagtactatttcaagacaatgcatcatgaatttacacatattcttaatcagaaaaaagcctatgatacatcatacgatcgtatatcggaatccgactacgtaggttcaagctggtatagggtatctgagtcggttgctctgcaaaaaggatttatctctccttatgcaatggaccgtgctacggaagattttgcggagatggttgctatttatgtcaccaatgacgctagtacttgggaagatatgctagcaagtgccggcacaacaggaagaccgatcatagaaaagaaatttgagattgtatttgattacatgctcaattcctggggacttgatttagacaaattgcgcgaaattgttttgcgccggcaaagtgaaattaccgaattagatttaagtacgctttaataattgtaggatatgagaaagattaaaatatatggcttactgacttgcgtttgcctgatgatgcaatcgtgtctgtttaatgaagatgatatctttgatgaatcttctgcacaacgggctatagcctccgtcaacgaatgtcaggagattttaaagggcgcagccaatgggtggttactcgagtattatacaggagaagacggagaatatggtggcttcaatgttttggcacgatttgatggcaataatgtaattatggctgcagatttcgctacagataattacgaaattggagaagaatctacttccttgtataaagttgaatcataccagggaacagaattaagttttgattcatacaatgaattaattcacgaattctgtgaaccgagtggttataattcaccaggatatgccggagattatgagttcgtcttcagaagcgtttcaaaagaaaagatcgtactgactgggaaaaaacatggagtaacgttgatcatgacacctctgcctgctgaaacaaattggcaagagaaactgaccaatattgccaatgtcgtttcacaggcttcatatgtaacctataagttaattgtgaatggtcaggaaataactaaaatgggacaggaagagcatgccttctcagttaccaaagtagacgaaaccggtgaaacaaccgtaagtctatatccgttcatatatacagaggaaggcattaaaatgtatgaaccattagtagttaatggagtagaaataaacaacttcaaatgggataatgaaaaccttacatatatttgtacagatacaggtgtagatgcaaaaatagaattctattgtccggaaggatatctcaactatttaggcaactatatactacaattagcaaatgggcaacgtatacaacttgagctcaaacaaaaaatgataggaaaatcatttgcaatgaattttgctttgagtggtactcctattgaatttgtctataactataatatgacaacagactgtattgatgtaccttctcagacagttggcgtatatcaaggttacaacgtattattatatccaggaattcccggaggcaatttctatgcagatgactcagctgtattccaaggacgtattgcaaatacagatccgcttacaattaagttcacttatgtaaacaatcctatttgcacccttatgttgctggtatatcaaaaaacagacggttggtatggattctctacaatgttccaagatgtaacattgataaaagttgattaattaacaaatagcatattatgaagaaaataacaagcatatttgcattattattatgcgtattcgtcttctcatgtagtaacgacgacgataaagaaacatcttctttgcagattgttagctcaaatgtcacatttgaatctgctggaggaaccggtacaataaaagttaacgcaataagtgaaattactgctacctccaataaagattggtgtaccgtaagcgtgaatggagatattataaatgtttctgtcattgaaaataatgatatgtccggacgtacggcagctgtaaccataacagatggtgaagcatccactttggttcctgtttcacagggtggctgtgttattctgtataataaatcagaattggggcatgcttttacttatgcaggtggttctgctacagtatctttctcaaccacagcatcttattcaatagaagtacccgccgaagcccaaagttggttatcatacacacttgacgaagaaaacagaactataacatttaatgttgctgcgagtgctgataaaaccccacgaggagcggcagttaaagttaccgcaggtaaaaaaacgatttactatcatcttggagagtatgaattgaaagacatcgcaggcaaatggagagtatcctttgttgatggagatgatagtactctagctggagaaatagaagtagttcaggatgaagaggaacctaccatcttctacttgtcaggtatttccaatttctttgacctaccgttaatctataatggagaggccttactcacaatgggaggtcttaatttaggaacatatgctgggagatataacatctatacagtaacattgtctgaaggtggatatgtcagttgggatatgtcaacacaatatgttgcttatccgtcatccatcaatggcaaatttgcattggtatttggtgataatggttcctgggatggagacgtagtcaatggcattgcctactgggcattctccggtgctgcgggaacaggaagtgcaggatggttggagaaattcaacgctcttacactaagcaaataagacggcaagcgtgcttagctaagtctgtctctctaacatgtataagatttagctttacattaattattcatataaagggtgttcaacattggacaccctttacattatccttttccatataaaaagcaatacaaaagatgatgttattattaaattaattcgtatctttcggacacacaaaaaagttaaaccaacaatcacacatatgaaaatgattcttttccgactaatatgtttaaagacatgcctactattaatccctgtactttacgcacaaaacaactatcgtccgggatttatcatcactgttcagaaagacacaatatatggagaaatcgactaccgtacagataagatgaatgctaaacgctgcgtctttcaatcacaaggtaatgataccgaaccagtaacctatcatcctttcgaaatcttgggataccgttttacagacgacggtaaatactatgtctccaagaacatagaattgaaatacggtgtctctacccccgtctttctcgaatatttgctacaaggaatgaaaagcttgtactactatgagacagaagataacataccaatctattttgttgaagataataatacccttgtaaaaatagatgcgcccaaactgtccaagcaggctaccaatatacagtttaaaggccagactgaccgatatattccccttcttcattacgcattcaaagactgcccaagcctggctccccaaatagaccgggctcgtttcagccgaaaggagatgataaaaatcacaaaagaatatcattatgcaatgtgtaccagtaatgaagattgcattgaatttgaagcaaaagaagataaacgttcaatacagttagatataactccttatgtaggagttattcaatataatgtaccatcgggtagtccgatcgggctctatagctcacccgaactatcttacctggcaggagtcactttagctatcagcaatagacggtggatgagttcgctcagtggttgttttgatgtgtctttttcccgcataacatcctctgcaagatcattgaataatgaaaattcatccactatatttaaacatagcggaacaatgttttcgggtaagttaggaatacgctatacctatccgaaaggaatggcgcgaccatttgttgagcttggagcagacttcagtggaatgatcaatgccaagataaagataaatgataagagcgagagatggctggatggtgtctaccctggctattacgccaatgcgggagtaaacttcaaactttcgcggaaaaacaaacaaatgatatgcatacgcgctcaattcaaaggcttaagagacatgatggaaaaatcagccctcgttaatggatggtcaggagtgataggatatacattttaagtactgcattattcgtttatatagtactcacactaggaaatctcttataaaaccgtttttcttgttatacccatattctacccgacaataaaactccccttatttcagcctttcgaatgaaataaggagagccttatataactgggttatcagctattaatacttgacttctcaggtattaataactgacgcgacaagtattaatacctgagaagtcagatattaagacctgtcgtgacatattagaatgcttgtaccagagtttattaactaccgtcttagtaagtcaccgtcaacggtgtacgcaccttctgcgcatactcagccatatacgcattccacgcatcaaccgtcttgatagcagccttatcccaggcagaaccccagtaataagtatattccgagcccggttcatactcgctgattgccaatacatgaccgtcagctccaccgcgcagctccttcttctccttttccgggaaaagaacggtctttgcctcttttaccagtgaaggaaatgcagcgccgataaatatcttaccgttaccgccgcttctgtcggttgtagggtctacataggtgatatagccgtttgcagcgtctgctgtaaccacaccgtccggttcacgaagaacgattccggtagtcacaggcatcgcttctttcaggttagtatacgaaacaacggttttgttgagatacgaaccggcatccaatgtgatgacacgcgtctccaccacgttagaatcgccacggacagtcaacgggttaaattccagcttcactgtgaaacgcagcgggccattatcaaggatttcctgtgtccgatagcaataaggatagataatcgtatcacccgccatcagagcggctgtaccgcagcccagcgtaggacctacggcataacaatccattccgtagccgtggtcaatgtgataagagatggcattttgcagttcggcagccgctttagggtctgtctttttcagttcggcaattctggcacgcttttccttatccagttcttcagcgtaaagactttcaagaatcggttccgtagtgttatacttcgtaaagaggtcgtagccgaaaccacgttcaccacgcttctgcaaggcagggccataggcacggtatccgcccaggtcattctcccatgccacgtcgtccagacgttcgggataatagcggccgcaggcaattacattatacgggtcgggagtaccggattggatagtataagtggctgtgccatttgctttcaccgtagccgggaaaaccactttctcgtcatacgtcacttgataaggtacttgctggccatcttcaccaagcactacgatctgagccgtatcagccagctgcagcttggctgtaacgtcactcatcggaacttcaaccatttcacctgtgcgctccaacgccagaggattggtcactgtaaccgtcattgactgcttgctgtcagcacaagaggcaaaacccatcagggcaatagcagccaaaataaatatcttcttcatattatacacaacaaataaggggatagaatcaggtaaaaaaacgaaaggggataaatgtaaaccgtaaactattcaacagaaaaacgataaggtgacaggcggtaaagaatctccttaccaccctatcaccttataataatctcttgttatcgttatttcggctgttttccgatataagccaggataccaccgtctacgtaaagaacatgaccgtttacagcgttagaagcctcagaagccaggaatacggcaggacctgtcagttcttccggatccaaccaacggccggcaggagtcttggcgcagatgaatgaatcgaacgggtgacggcttccgtctgcttgtttctcacgaagaggagcagtttgcggagtagcgatataacccgggccgatgccgttacactgaatgttgtattcaccatattcagagcagatattgcgggtcagcatcttcagaccacctttggcagcagcgtaagccgatacagtttcacgacccagctcagacatcatagagcagatgttgatgattttaccggcacgcttcttcatcatggcaggcaacacagccttagaaacgatgaacggagcgttcaagtcgatatcaatcacacgacggaagtcagcagcttccatttcgtgcataggaacacggcggataataccggcgttattaacaaggatatcaatcgtacctacttctttctcgatagtagcaaccattgcctgaacagccggttcgtctgttacgtcgcatacataaccgtgagctttaattcccttttcagcataggcagccatgcctttgtctaccaactcctggttgatgtcgttaaaacatacagtagcgccttgttctgcgtaagcagaagcaattgcaaaaccgataccgtaagaagcacctgtaacgagagctactttacctttcaaagaaaaattcaaatactgattcataattttttgttattaaatgatgaaaactattgtagttgtttattttaaatctgtaattaatgagaagtcctgatcgccataatcgaggttttcaccgcccataccccagataaaggtatagttgtgggtagccgcagccgagtggatcgaccattcgggagacagaacagcctgatcgcccttcatccatacgtgacgagtttcgtccacctcacccataaagtggcagatagcgtgctcttcggggatttcgaagtagaagtaagcttccatacgacggctgtgcacgtgggcaggcatcgtgttccatacgcttcccggagcaagttccgtcatacccatctgcagctgacaggtaggcaatacctgattgaccagcatcttattgatgttacggtggttggaaccttccaacgagcccatttcagccactacggcatccgctttcgtcactttacggtcgggatagttgcggtgtgcggtcagtgagttgaaatagaatttggcaggattggaagcgtccttgctttcgaacgtcaccacacggtcgcccgaaccaaggtagagggcttctttatagtcaagttcgaaaaccgcatctccggccttcactacgcccggtccgcctacattgtaaatacccatttcacgacgggtcaggaagaacggagccttcagcgggtcgatcgcttcgagtgtcagcacctctcctaccggaagcgcgccgcctacaaccatacggtcgtacatggagtacaccatattcacttcgttgggaacaaatattttttcgattaagaaatcgcgacggattcttgcagtatcataactttttgcatcctcgggatgcgcagcatagcgaatttcatagttcgttttcataccttatttatttatagttattgaataagctctctttctcaaatgcacatcgtttacgtacacgatgcaaaaatagtaaaagaaaacgggttaaccttgcaattttgttccaattatccaccaaaaatgtccagaattgatgcaatgtacatctttttaacgaactataatacgttttgaaggagtttgacgactattttcaatgatacaaaacgatataaaaaaaggaagctccaataatcaatgattatcagagcttccttttggttgtcctaccaagattcgaacttagacaaacagaaccaaaaactgttgtgctaccattacaccataggacaaacatatgcgctttctgttaaaaagcggtgcaaagatagaggtttgcaagcaaacctccaaatatttcgattacttttttactttgccaccttgcaaatcgctgaattttacttcgcgatcagcagaaaatagttctttttaccacgctgaacaagcagatatttcccgtcaagcagatcggcagtcgtaataacctggtcaaaagcttccagtttttctttattcaatgatacgccaccgccttgaaccaacttacgcatttcgcctttcgaagcaaatacagccgcattatcgacaaacagatcaacagccttcactccttccgccaaggcgtcacgagagatttcaaactggggtacgccttcgaatacagccagcaacgtatcttcgtccaacttgcgcaacgactcggaagtagcgttaccgaacaggatattagacgcatctaccgctgcattgtaatcttcttcggagtgaaccatgatagtcacttccttggccagacgtttctgcaaagcacgcaagtgcggagcctgctggtgctcggccactaatgcttcgatttcttccttctcgatcgaagtgaaaatcttgatatagcgttctgcatcagagtcgcttacgttcagccagaactggtagaacttatagggagaagtataacgagggtccaaccagatatttccagattcagttttaccaaacttaccaccgtcagcttttgtgatcagcgggcaagtcagcgcgaacacctctcccccattggtacggcggatcagttctgctccggtagtgatatttccccactggtcggaaccgcccatctgaagtttacatcctttagtttcatacagatgaaggaaatcgtagccttgaagcagctgataagtaaattcggtgaatgacagtccgtcacgtgcttctccgttgaggcgacgctttacagaatcctttgccatcatatagtttacagtgatatgcttacctacttcgcgaacaaagtcaaggaaagaaaactctttcatccagtcataattgttcactaattcagcacggttaggcacatccgactcgaagtcgaggaacttggcaagctgttttttgatacacgcctgattgtgacgcaatgtttcctcgttcagcaggttacgttctgccgattttccggaagggtctccaatcatacctgtagcgccaccgatgagtgccagcggcttatggccgcagcgttgtaaatgacgaaggatcatcactccacaaaggtgaccaatgtgtagcgaatcggcagtcgggtcgatacccaaataggcagtcacctgctctttgtttaacaactcttccgttcccggcatgatgtcctgcagcatgccacgccatctcaattcttctacaaaattcatcgtattactctttttattaggtttttattgtctttcaattccatgtgcgacaaaagtacgactctttctcggaagatacaactcttaacgcctaaaaaagactttttgaatattttcccgaatcgcctgccgcagctcttccgcatccgtgcttcgtgctttcgccacctgcttcagcacttcttcaatgtcgaccggactgtcatccgtctccagaaacaggcgaccgacaggcactcccttcaccgtttcctccgaataatgcgcaccgaaagaaagataaatgccgttctttatcagttgccctgcctgctgcggtttcccgcgaaagccgtgccaaatccagggttgagccggattcagtttcttcctcaccgccagcaactcatccatcgccttcacacaatgaataatcagtggcaaccgatatttctccgacaattccacctgcttctcaaacatccttacctgaagctccatcggagcagctgtcagtttatcgaaacccgcctctcctaccgccacaaactgctctttcacaagcaactgctgcagaagttcaaattgctcttccgcattgcgttccgtcagtttccagggatgaatgccggccgaatagaaatatccctctttacctgccgtcctgacatccgaagccgacaggcacagcgaatcatccaccggtaatggaaaattgataatcgccctgccgtgggaagcatcctccgacttgtgagtatgaatatccagaatatgactcgcgttattctccatatctctcgttctttagggtaaatcgtttttaaggcacaggatcataaccggaaccaccccacggatgacacctgagaatgcgccggacagccagatagagtcctttgacgggaccgtgtttcttgattgcttcgaccgcataggccgaacaagtgggcgtaaaccgacaagacggaggggtaaggggcgaaatacacacccggtaaaaatagataggaatcagcagtaagaatgaaaacaccttcctcacaagacttttcagggacatccagcagacggacacccggtgagcacggggtttcataaggataacttttcagaaatgcgcgaaagcgctgtcttcattttctcttccagttcggcagtggctacaagttcgtccgacagatagataaaagcaattgccagacgctgccctttgttttgcaaaccgtccagcagtggctgtttgttcttccggtagacttcgcgtatctgccgcttcacccgattgcgctttacagcacgtttgaaacgccgcttcgatacgctgataagtatcgttgccggcacttcaccttgttctacgggcatatatacaacgcgtatcggaaagatggaaaacgacttggaatggccgccttcgaacatctttccgatcaatattttactattcagcctttcggctttacgcaaagtatatacgctcacgctgtttatttattgttttccttgatgaacatatcaagcgcagccgtcattgacggagcctgcacagtcggtgcttcaaggtccaaacggagtccggcgtcgcgtacagcctgcgcggtagtcgacccgaaggtaccgattctgatctctttctggtcaaagtccgggaagttcttcttcaaagaagtcactccggcagggctgaagaacacgagcatgtcataatcaaattcctcatccgatgtaaagtcattgctcacagtgcgatacattacagcttctgtatgctgtatgttattcttgtcgagcaggtttttcacatcatcattgtgcacgtccgacatagggacgagatatttctccgttttatgctttacgatagatggcaccaaatcttcaatctttccggtagcaccgaagaagattttacgtttgcgatattgcacatacttctgaatgtacaatgcaaccgcttctgtgacacagaaatacttcattgtttccggaatagtcacacgcagctccgtacacagattaaagaagtgatcgattgcgtggcgtgaagtgaatataacagcagtgtgatcaagaattgaaaccttctgttgccggaattctttcgccgaaagactctcgacctttataaacggccggaaatctatttttacgccatatttctctgctatgtcgtaatagggagatttctctgacgcaggcttaggctgcgaaactagtacttttttaattttcaacgtcctaaatttttattagcaatacattgtttacctggatcattccctgatagagtagcagacagggtatgatttcaagagcgcaaaagtacaaaattaataggaaagccgcacttaattgatgaaaaaaaagctttacccacttataaaacatcaatattttagtaaaaattagaataattagtccgattatcactaaattggtcaggttcagatcgaaataaacaaggaatagaacaaaaggaaaaagggcgaatccgacgtaatatatgagcgtagaataagattccaaccatatatttgtcttgtttttgtcaaaaaacacccatccgaggaacatataaagtaaccatttcagtaaaaaataggcaagacagaagccgacataaatccccaatagcaggagaggggagaccttggtcatcagcatcggacatgtatcatgaaaataattgaagaacacgatacctgtcaatacacaggtctgcactaccagtacgagtagatagcgcacatcggctgccgtagaactatcaaaaatgcttgtccgctcgcgatgcaatacaaagtctttcacctgttgggtgagaaacttctttccacgagccagagcgatggaggaaagaaagaagcaggcaagcaatgtcaaggcaatcacatcatccgtacggggagagtaggagatagggattccctcgaatccggagttcagaatatcggctatcatatggctgcaaatttacggatagaagcgtcccatacgggagttgtctgaagtaactccaccgcttcttccggtgtttgtgccactttccatatatcaccgtgttgctggcgcatgaagttttcctctattgcccgttcgagcatttggaacagcggatcaaaaaagccgtttatattcagaatgataatcggattcagatacagtccgagctgtttccatgtgatgatttcaagcaattcttccagagtgccgcatccgcccggcaaggcaatgatgccgtcgctcagattcgccatcttctgcttgcgttcgtgcatggaagtgacttcgatcaattccgtcaaccctgtgtgatgccagttctgttcgaccatgaagtgggggataacacctgtcacctcaccgccattcttcagaactgcgtcggctacggagcgcatcagtccgatgcttccggcaccgtttatcagacggatatgttgtttggcaagcaggcggccgagtttttcggctgcttcaaaatatacgggggctatcttagtgctggatgcgctgtatacgcatacggaatgtatctgattcattgtcttttgcaagtttactggatgaatgggtacaaaagtacaaagaaatcatatacatatcaaaatgaatgtgcaatttatgtcaaagtgaagatagaagaataaacacaaaggcaagactgcatattctatttctataaatagcacagtcaagcctatattctcctacttcaacactcattatttaaatattggcataaaaacagaaaattgaatatttcgtgaagttacttttccaacaccactagtattcatcagattgcaagtaccttgtttataagatagttgtagttcaagccatttcagcgtataactaactcttgccacaataggtatatcgatcgcattttttttgctattataagtagatgcacccaatcgatttacataccaagccacatctgctccgactccaagtctaaaattagaaaaacattcataactgaacacagtccctattgatagatattttccgtttacactatacttaggactatccgaattgaaggcttgataatcagtcccctgcgagccaaaaagagcaatgccatccattgcaaatttacgattaccccaatactgccgataagcatatccaatatgataatgaagtttatatccctcaaaattactggaaaccacactcactttttcatgcaatgttcctaaagagcctcctaaaacaggaccatgttcctgtgcagataatgatgctgtaacaaatagcaaagctataaatattaaattagtaattgttttcattagaagttcagtttttattatttaatatacaaatgatgaggacaaaagagtttatggttgttgctactttcgtcctcatttacacttttataatctcacagtggcaaatcctctttggtcatacggcacaccccgagaccagatttctattgtacccgtacactcttgtgctaacttacgtccaaaaactttggttacatttccacccatttctttggtatcaatagcaaaaggaataccatctttatttacatacactggaccataccccagtagttctccttgagcaaactcaaaaccacgaaggtttactttagcatggtatgtcgtagagtaacggctccatccaaagactcctttcttttgcgaagtaaaattagcatgtattattcctgatgaaacagataaatataatcctacttttctatctttttgacgactatatgcttcgtttatagaacttaaatctgaaacagacgaacgagtagaaaccgtaaattgttgttgacgctctttaaagtcagtatataccttatccacaaccaaagaatcgccaatcataaattcacctttcatattaacaaagtattcattggctacataaacaagccttgaataaggtgacagatcagtagcatcgatagtattaaacataaatacatcaccatatttatgtttatatttctcatatagaacatcaaactccgctttatcagcagcttgattacagattttatccaactcaccatccgcttcttgcatcagaatcatctgagacttaaaagataatgaattaagaaaactaacttgttctgaagtagacattgcactcactttcaaaagagcattctcgtacgattccacatctttaaatttaatcatagtaccgtcgtttattacttctatttcagaattagcattcgtcggtttaaccatattcacttcctgttcatcattggtacaagaaataaatgcacctaaacatactgttagtgtcagtgttgaaaatagttttttcattgttttttcttttttagttaatatcaattcgtagttgcaactatctttatgctattttttatgactcaattatttaatagctttttctatccttcaataatcctgtactcaaaatacccttaccaaaactttgaccagattatctgctacaaaagtagagataatggaggtatcgacctagatattcaattcagtaataattcagaaataaaaaatgccatttgatctaaaaactgaattatttctgaactcatccatactaaacaatcagacaattagcctttaatttgcaaaaaaaataaaagaacgatcatgatgaaaaaactactatttattgcaattattgcagtattaggatgcacagcactccaagctaaaaatcgcatcagaataaaaagagagtcttgggaagtaaaagcaagtactagagtgccaatatctaccccccttaatctttactacgaagggagtacactctttattcatgctaatatagatttagaaaacattataattgaagtaaaggattccttcaacaaaactatctacctagaccttacaagtattcaagctaacaatgaacatgtatttactctggaaaatatatcttccggagaatatattatcgaaataaaatccggcgaaaactatattatcggttgttttatattataagtcttgatatatgtgtatattgctttatatatatgctccgccaatataagcgaaccgctcttattcaaatgtacattatcccatacatagcaagttgaatcaactttatgttctaatgggctatacagatctaccaatttcagatgaaacttcctagctactttcttttgtatcggataaatttcatcttttattatttcattacgaatcccatataaattattacttgccggaatacaacgacatataataatttttggtttagatccacacttctgaaaagtgctgatcatatactctaaatcagtttcaaattcatccttatatttccagttctccggcttggaatcatttgtaccaagtttaataattacaacgttcggttgaaatttctgtgcattgataaatgcatcggtactcatataaggatgatcaccttttcgcaataaagtatggccccactttccaaaattgccaacttcatattgatttccaagcatacgagccaaaggagtcggataattgtcagccccttcagttatactattgccaatgcatgctattttaattttatcctgcgctacaccacaaacaggtataagcatcagaaatgcgaaaactaatattcgaactattttcgtcatatgattttgtattctagtcattatttttctgtttttaactgaaaacaaaacctttttacctttaaaaaacagtctacctatcttgacctacggtattttacaagctccctccggctgtagtaagagcaatgaggagcaaattttaaccggaggataaacttgaaaaccaatcaaacaccaatcctaaccttttacctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaagaacgagtaagcaagcaaataccactaaaaagaaataaaaaaatatctataaattttaattcatacgataaaaggacttgatcttcaaagcctattttgttaagaatcactttacttacgctcaatattgagtaaatattctagaaacaaatcgcataacctcaggtaattccatccgccaataagtccacgaatgactgccgtctttcatacgaaattcatgaccaacctgatgctgtaacaacgtgttatgtaaaagacagttcgttaccgataagaaatcatcatcaccacaactgatataccaacgaatccatttgatacggtctagcttttctttcggagatttctccaagatagtttgtatatccatttgcccgagaacttccgcttttttttcttctgacaccttcgataaatctgattgattcttcatctgatcgaatgtccatgcccctccaacagcacttaacggagcaacagcaacaaacatctccggataatgaagggcataaaacaacgctccgccacctcccatagacaaaccggagatagcacgataacgactttcagcacgcactctatacgttttctcgatatgcggaatcaattcttgaaaaaagaagtcctcataattatatgttccatccaacaagttaaaataacctttatgaaccgtgtcagcatctggcataacaataatcatcggagctgatttcccctcagcaatcgctttatctgcaatatactgaacctgcccaaattgcacccatcccgtatgattatctcctaatccatgaagcaaatacaataccggataactaccatctccttcgtcatagcctgctggcaaataaatggaataactacgttccattcccagaatcttactttttacggtacgtgtctcatacactttcccttgctgggcaaaagccgtagtaaccagacacatcgctaaaagcgctgataataaatgttttttcatacgtatctattatttcatgtaaatataatatttaaaattacctgcttttaattgaatcattttcttttctatgcgaatattcttcccatccatcatacaggacaccgcctcatcgggaatacagagtgtagcagtaaccccaactggaatatccacttgaagatccataatattatctgtcaattcccagtcaacagcaatcacaccatatggagtatcttttgccatcttagcccaagtcaaacctttcggtatttgaggatcaataaatacatgttgataacctggtatcgattcatctattctaagtccccctattgcttgataaaaccaggttccgattccattatagcagttatgcaccctactccgttcaccactccaatactcccaagtcgctgtagcaccattatctatcatatacagataacctggataatcacgtttcttcaacatttgatataaaaagtcaacttccctgttacgaatagcccactctgtcaaaattgggacacctaccaaccctacagcaatatgacctttgtgctgcttttcagtatcagtcatcatctttcttttcacatcatcatacaaagaatccggtacagctcctacaagcattggataacacatatccaactgtgaacctgtagaatagatacctttacccggatgataaaacttttgatgaatcaactcatttagattcttcctgcgcatagcaaacttctctgcctcctctttttccccaagcatcagagctattttttccattgtccccaaacattcactgataaaacaattatttaccagatcaacagaagattgtgctcctgcatctactcctatcggtgcaagccagtcaccaagaaaccaatcccgatattgagtatcaggccagcgtttcagcaatccatccaccgtatatttatccacatatgagaaccattctttcattttcggataatagttctttattaatctcggatcattgtaattcacatacgttcgccatggcgcctgtacaataaatccacaccaatacggaccaccgccacctgcaccgggattaggacctacatgggccagacttcccccttcgcgcattgaatctccccatgtttgtatccagtttgtgaaagtcggtgctacgtcatacattgtttgcaaactcattgtagacgaatttccatcgccaccatagcctgcccgctccaaatgcggacagtcgaccatatatccgctaaatgtcagacacctcatagtatattgaatcatattatgaatggcgttcaagtcagcatccgaacattcgaaagtcgcagtctgccgataatcgccataaatctggagagattttatccattcagttttcggtcttgccggaaggttggagatacggacataacgataagcatgatgattgaatttattcctaaaatattctcccctccgtccacctgcaatatagacatcactttcaccttgtttgtcaaattctccttctttagtcaggttatcgctatattccatcgtgacctcatgtcccgcagataacatcggcatcttcatttcaaaccatccggtctgtattcttcccatatctaccaaccaggtatcttcactaagtttcctgatagaaacaggttgcaacgtttgatgtatcttgttagcttcacacatttgaggtgaaacaatgtgtcttggtacatttacttccaccacaggataccatttcattttatctagagaataagttgaaaaatctgtcggcactattctcccatccaccctttcaccaccaaattgtaaagcacaccaattacctgtatccgaatagccactttctcgtcccctccaagaagtgtcagttgcagtcaatacttcccattttccatttctcagcatattcagttccgcttttaccaacggaccgtcataagcagcaccaaaagtagttttcttataccacccttgtccaagccatatcagcaggtcattctctccttctttcaaataagaagatacgtcataagtgaccattaacgaacgtttattcagttgagagactgcaggggtaagaacattctccgtaaccttctttccattgacatatacttcatgatatcccagcgaattcacatacagaaaagtcgttgccagttcacctatttgcacttttttacgaagtaaaggagcacaaaccttacctccttccggtgatgaaccgatatagacaccgtgtatctgttccttattcaaaagaccaacagaaaaacgcgccaccggactccattgggaaacatgccttttccgatcccaggcacgtaccctccagtagcataaagaacgcgaagccaaaggtaagccttgataaggcaccatcacagaaacatcagacttcaacttccccgatttccataagtcagccttccccccaattaatagaagactatctgacgctacctgaatttcgtaaaatgcttgtccatccaccaccccatctcctttcaacttccaactcaaatggggagtaacgttgtcaatccctaaaggatcaaccatattctcacattttaactccactaaagaaaaagagaccttgttttctttcccatgtacaatctttggcaaacaccaaagacaacacattattcctatacctagtaacagttttttattcctcataaataagtttctgcgaatattacagctatggatcatccccccaacactcttacaatggataatgcattactcaacctatctttgtcaacttgactttatgagttgtcggcttattcattttataaattgtatcgacgatgatcttcatatatctactccatacttcgcgtatctcaggatacatcgctttggtataccactcataactcatcctcagaaaaccatctttaggtaaatactccctaagtttatttatagccttctcattatcagcaaacagcagaccttcctttttcaagaacgaatattctgtccacaaatattctctgaaacgtttttctacttcaaaacgttcttcattcagatacatgattttcatggcttgctggtattggggtgtattgggataatcggccaaattgataccatcttccaactgtccagatgaaacattatcgataaacaatccatctattgtcagccgataatgtcctttttctaaattagtcacctgcaaacgttcttgattaaattccttcataaacggtatcaaatccatagcatcacgttgtgaccttttatttccccaaccatgtcttggaatagaatccaaaggataaggaagtgaatttgccaaataatcaaaacttaaaccaccagcttctttctttagtttggagaccttacaattcctatgacttaatagattcttgttatttgcatcaattgaaatatccgaaacttcgactccagccagtccctgcgcctttaaaaataaataagccatcaccatctgtccatcattatcaggatggattctatctactctacaaaaagtgaatgtcgaatctttcttttgctcttccagacttatttgcaccatcggctgattaaaatccacaaatccccatccatttttcttcgccgccttacgctgggcatcaattatctttaaaatagcatcatttttatgaagaaaaagtaaactgttcaatttcgtagtttcatcataaggtgatccacctatcagcactttggtcattttattctctgccagcaagcgcttctctatttcccgaaagctttccaaagatttttcaatccgttgctccgacaactccttagcattctccttccagaaaatatcataccctgtgtcattcataccaaaagtcagagttacataagtcggttttctgtcaaaaacatcgtagtccaaccgatctttaatatcccacgcactctcaccgccaattccggcattcattattgtaatcctttgggggaggcgcttagtcggtgggcgtggtcgccccccttgccgcagggcgttcccccaccgaagggggtgggctgtagccgtgggagcggctgcgctacggggtcattcatgtgttcgttatgtgatttattccttctatactttttagtgatattcgcccgattgtcacggatttcccctgttcgttacttttcggcggggcgtttcgccccgctccccggagcggacggcgaagccgatcgccgaagatttccggcacgccgcagggcggaagcggtctgccgggaacgccgcaggcgcaatccgcaggaggaacgaaaaacgggagtaacttcggggcggtggtcggggtggcggcttgccgccatagtggaggcgtaaacattccgcagggaaacatccggaaggggtaactttctgcccggttatgccaaacactgtctttccggggcgacgtgcagaaggccacattatgttgaatattcctcacgggcggaacgcgccggaggatattaaatataatgttccttctgcatctcgcccaattcaactatttctctgcaaaccactgctacccatagcgcacgcaggcatcacgtcagcacggcggcggacgcttgcgccgccttcatggtctaatcgctcaggaatggtcaatcataaacacgggaaccccgcaccgcatggcggcacttcagactagtagcctgtttcctgtcgttcagacgaaagaaggtagcggattgagcattgtcccggcagaaagtgccgggcagagcgaaaccgcaccgggcattgaaaacgactgagtacacaccgcatgggctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaccagacggaagtaacttccgggaaacgtccccagctgtacttcctttgtatcaccgccaaagggcggctttctttgcgccaatcggatgactacggggaaagcaagggaagcggcacggtgcacggaaatactgtccgaccgataaacgctggcagtgaaggagaatcccggtagtaacactggaggagcagggcgagcgcatggggtgcagtcctgtaaggctgcgccctgatgcggttgcgctgcggtgggtattcagacgaactgatgttcgcctgatcacttccgtactcctgtgtccgatctgccgggattgctatcacacacctggcaggatctgcacctgatcatcccgatatcacctgttagctgatagcagatcacggcggccggctttttcctggacacaacttttgctatcactttgattcagctcaggaactggatccggagaaatccgatagcagatactaaaccacctgtgcaatttaaacagcaagaggttcttctttaatgatcgagattccgagtgcattttcaatcttggccaacgtttcaagcgaaaggttttcccgtcctttcaataccttcgaaatatactgccggctacaattcatcttctcagccagttgcttctgattcatttccagttcctccattctatcgagcatcagcatcgctatatgttgggaataccgcaaccaagtttcattagcatccatgtactcaaacacttcacgccatttcgacggtgttggagatgcatgcttttcaagcctctccacaatctttctcatgttctcattcatatatctacctcctataattacaattcactcatataatcaataaacccgtcatcatcaataatgttctcttccagcaaatatcgtctgaccttatccattttcacaagttcctttcttgtatgctctctttcctgcatggtggcggtcagtttgatagctccccccgtaatgatgtatacgccagaagtcaatttgatagcataaagacgcagccaggacgaatgcccgatggtacgtttcaatcgggccttttctttctgaagcataaaatccgatgcctggttattatccagcggtcgaaacaatctgctcaaatctgcctccggagatatgtccataatgacgcatctcaatctcttgctgtcttcaatcgtatccttaatcgcctgattgatatcagtaattttaaaataggcactcaaatcgtttatattttctttgaaaaacgaccgtagccacatcacatcactccaatcgtagaacaatttgagaaactcattatcttcctccccatccaggcgtacagaccacagttttttgcttcctgtaatatcgtcaaatgtcatatttttcctgttttgtttccacaaagatacgaaaaagaatcgaaactgtcaacttataagttgacagttttagttaattaagattgttttatacaggctttgcgtgtgactgataagtggtcgtatcagtttcccattcattaatatctaaatcattctttgtactatctaatggtgaggccaccgtttcgcgattgctttcatcaggaagcatcggctcacaaccactcaacagatggagtacaaacataactatagcaataatagctcccgccgtcaaatgcccctttatatgatggaaatatcctctcgcatacgcttcgccccgactataattcttttgcattttttaattttttagtccgacaaagttaataaattaaatgcgagatttgtctctttttgtcactttaattaggtttatccgattaaaaacaatacctttgtaggagaaaacttgaatcctcaattggatattaaaagagggtttttgccaaagtaggtgtctaattcggtgacactactaaaaatgaaagctgttatttcattgaaaatgagattataaagaaactaaagtttgagggcaggtagcccaacaagatcaacgtcaatgatgaatacgaaaatcccgctaaaatgaaagttttagcgggatttttgctttttgcggtatactttcatagctggtaaggctcaaaaaaaagagtcttccaaaatgaatggaaaactctttttacatcagcaccgtttaggtgatgtttttctgcatctatgatgggatacctattgtgtctgtgttatgacatttggctgctaccaacccggattctgaacaagtttgctcgacttctgaatctcgtttaacgggataggatagaggtacatgcgtctttcaaaaatacgggtttcaaatgcggtacgctccataaagtcctccaggttatcggcattcatattcataccatgtaccggtccgccttgcttatatccttcttcatcggcacacatccagcgacggacgtcgaaatagcgttgtccttcggcgaatagttcgatccggcgttctttgcggatggcttcttcctgtaaggcttggttgccttttatttcaggcttgatgtcctttagtaaagggatacctgctcggtagcggacactgtcgatatgtgcaatgatacgttcatccgaaggatttacatggttcaacgcttcggcatataataaatagaagtcggcgagacggaacaacattcctgctctgtattttgatttggcattacttccttggtttaaaagatcacggttcattcccttgtaaagcagatagccggagtagctcatatccgctttggagttatcgtctccgctgcctttatagaaataaatctgtttcgttgttttttgccatgtcttgccggagtaagttatggcctgataaaaacgtggttcgcgattcttatacatattaggaatgccgtcttcgccaatgccttcttctgaataaagtcctgactcgtgaatactcttgccgtcattcatgtagaaatcgtcaatggcttcctgcaatacacctacacaaccgaatccgctatatatcgcacgtggagtgcatctgcgttctcttccttctccacctacatcgccccatgaattcttgctggtttgccagatagcttccgggttgttcaaacttacctgaaagagttggtatagagattcttctgcattcaactctccatctttatctttttctttataaaggtgatagtgagtttttgcataatcaatgaagcgctgcaacgcgtttaaggcagtttgccattttttgtcatctttcgcaggaaacagttgtttgtcctgattatccctcaatgcgattgcttccgaatatcctccgttaagtaaggggcttgcggcatacacgtggagttttgccagaatagccaatgctgcccctttggtaggtgctgcgcttcggttctcgtttggagtcccgtcatcgttcacttccttttcaggcagttcattgtagcattcattgagttcggaatcgatgaattgcactacttcgtcgacagagttccggtaatagtccagatcacttgcggacggttccgatatttctgtcataatggggataggaccatacaattcaaataacaagtagtgatagtaagcacgtaggaaacgagcttcgtttttcaatcttgccaattcgtcttcgtcaatgtaatccgtaacgtcaccttgctgtgggatcgtatgcgagtatgccagaaattcgtttgcctgacggatttgtttgtaaagactccagcgcgataaatccgccgatccggcatggtaacctactgtcggaattgtcttgacattattttgtgcactttttaactcgtcggaaactgccggccagggattatccaatcccgtcaaggctgcataagaactggttataataatgtttgatacatccggaattccggaatatatatatcggtggaagcgacgggcataaccggtattattgaatacttcttccatgcttaattctgccgccaggtcgtccgatacatccagataatcgctgcaacccgaaaagaatatcgtgcttagtcctacggccactatgattgatagttttttcaatgtcttcatatatataatgtattatatgtattattagaaagtaaagtcaagaccgaatgtgaaagtccggctcagtggatatgagaagccgccgttggtgtttccaagttccgggtcccacattttgatatcatcccatacacaaagattgtttccttgcagataaacacgcaaagcttgtataccgatttttttcagtgttttctccttgaagttgtaaccgacttcaatatttttcagtcgcaggaaactggcattgcgcagccaccaagtgctggcagctgtattgttgtcataattggtagagtgcatgcgggggaacattacattttggcttgggttctgttccgtccatctgttggctacttctgatcgtacggcagactcttcgactccccattggaacgggaaaaatgctccgttcgagctggctcctaatacggtcgatgtatttcctgaaccttggaagaagataccgacataggctcctttccattcggcattgaggccgaagccataaactatttccggaacggaaggatttcctacatcttccatctggtcattgctgtcgatcttaccgtctccgttcaggtctttgtatttgatatctcccggacgtactccgcttgacagaccggatacaactcccggtttcagttcatactggcggttcagaccttcacctgttatgttgaagtcgtcggcggtataaagtccgtcagcaatgtatagtttccatgagttgaggcgagttcctttcttttcgagccacggataaacttgtggcacctgatcatattcgaggatttcgttgcgtgcaaatgtaaagttaccgcgtgcgctcaggttaacttcacctactttataattgagattcagacttgcatccacaccttggtttttcacgataccgaagttttgccatggcatttgctggaagcctgtcacattggaaacggtattacgttgcaataggatgtccttacgtttgttgttgaagtagtccacttgcaggtcaatgcggttgtcgaataaccccaagtcgataccgaagttgcgtttgtcttcgatttcccaggaaagaaacggtgattcgaactgggcttcggtaattccattgcctactccgcctaatgcgccgctgttgctgaatccgatattatagccgctattatcctgtttcatggttccacgatataagaagcggttgccgccggtatcgtcgttaccggtacgaccgatggagaatcttaatttcaatttgcttactacctttttcaaggcttccggataataatgttcattgctgatataccatgccaaacccatggcggggaagaaaccgaagcgatagccttttgcaaaggtttccgaaccggtgtagccgaagttaccttctaagaaatagcgtccgtcatatccataagttacacgacctaccaaaccttgctttctataaggtaaagcgttattgtgatactgtgtttctttttgcatgtataggaacatggcccctacatcgtgtttctctgcaaatgtacggttgtaattgaaggctgtttcaaagtaaatcttcttgtttgaactgttactcaggttttctgatagtacatcgctgccttctactacagtcttatataacagtttgccattttcgtcgcgtcctgtggctagatattgtgtcggtgttttggtacgtttggcgatatatgacatgtctgcgtcaaagctgataagtcctttccatgtcaatcccttggtcaggaagtccagcttctggtctacttccactttcgactggatggaagttctccattctttggcgtatcctgagttaacaagcaggttgtacgggttggaacgattgcctgacggacggggatgtccggccacagttccgtcggaataaactgccggcatgatataagacggagtacggcacatggtagtaaaaatagtgctggttcctgttcccggataattggtttgcaggtattgtccgctgaggtctacttttactgttgtggttttagttgcgtcaaagtcaatgttgctgcgcagattgtagcgcttcaatccgatattgttatcatagtcattgccgaaatccttgaatataccattttcctgatagaaggcgccggatacgaagtaacgggcacgttcagttcctcctcttacgttcagggtataccgcatattataggtgtggtttcttagcattgtacccaaccagtcagtgtccggatataaatcacggtcggctccgggaccgtatttggctatctcttcgtctgtgcgtatgctggcggtcccttcgttgttcaatgcttcgttgtataggtttaacgtttctactgagttcatgaaagtcggcagacgtgttggttcgagaatagttccttcggctcggaaagagattttaggtttctgtgaatttcctcgtttggaagtaatcaagataactccgtttgcgccttcggctccgtaaacagctgtggcggcagcatctttcagtaaggtaaatgattcaatttcatccgcttcaatatcctgcatttgccgggggacaccgtcgactaatacaagcggattggtaccgcctttgaaagaactttgtccccgaatccaaaagtcggcattgtcatatcccggttcaccggaacgttgcactgcgatcaagcccggtacttgccctgccagattattggtcatattacgactggaagaaacggacaactctttgggaccgatggcgttgatggaactcactacgctgttcttcttttgttttccgtagccgataacaacgacgtcctccagcatctctgtgctcggaagcattttgattgctaataccttttctcctttataagtgattttttgctgttcgtaacccacataagagaaaagaagtatattgcctttttgggctttgatggtgaaattaccatctacgtcagtgatggcaccgactgtggttccttcgatttttatctgcactccgatcatcggctgcccgttttcatcgactacgagtcctgtcggactttgtccttgtgcataaattgtgtttattcctgcaaataaggcaaacagaatgaaacacattacttttaatatcttattcataaatgtttcttttaagtaagaattagaaaataattaaggttacttgtccgtgccgtatacatatatttctgccaggtgtcctacagatgaaccactgcccagagtggggatgtaaatacgtatccagcgtgcatcacatgcttttacggggaccatttgctctgtttttatgctaccgtcaaagaagtattttccaatcaggttccatgtttcaccgtcatctcctgcataaatctcaaggttcatagaagtaagtgcattttgtctggcgatgagtcctaattggctgacactgttctctttgcccatgtcgagtattatttcgtatggtggagctacttctcctccctgccatttactatgccagaaagtgtttatctctccgtcaatcaaagatattgtctgaccgttgtgggggtaagcggctgaaacttcgcctgtcttttcttccgtgttggcagtcactgtccagtggtcacggttaatagggccgccttgtttgattacgaaatagttggctaccgtttccttgtctatgttgatgctggcgtctccttgtccgctaagtccgccgagtgaaaccggaagaagataatttccggggggaagtgtttcacccagcaggctaatagcagagcctcccgttgtctttcccttggcgatagtgacatcgggaagagtgtagaagtcggaaggtaaaggtatgtaataggtcgaatttgccgaattgtagttgtccacatagtccgctcctttggttgcaaacgaggtcgtcagatcccattcgttctcaaagcttatctctgtgtcgagattcataggtgaagtagtcgttcctccttctactacgaagtctcctccggtagatgcaagtctgacgatggcttctttaacgataaatccgtaaagtgttgccgttcggtcggagttcataggagtccctgtagaggatacccgtaatggaagaacgtatttaagttcatcaaagccgcacaggttgtagattttgtgaggatcatacaccagactgcctcctgttacgcgcctgtctccgccgggagagacggaataggttgcattttcaatcgtatagcattcgggaggtagtaattgataggaagtgccgtccgcattattcagagaatccaacagggattgttctactgaaaaagtcaccgttcctccggtatcctctaatcctgccttggcaatggatagatcaatcttgttgagagggcctaaatcgtaaacttcaatggtggagaatccactttgtgatgctgagaacattcccttagaacgttcgttatcaacatcttctacgcagctggtaatgcataagaatgccagcaagcatggtgttagttcaaagcattttttcataaattaatattagttttattaaaggtaaaaagggtaaaaacaagttgaagtacttgtgggtactcttggatttggaatacttatttcattagatcagttttcaataggtattagatttgttttttaggaatagtttttaggtataacaattaaaaagtaggtattatgaaacgtttaggattaacattagtggcagcactctgcctcgctgcttcgacttttgcagcaggaaaccaacctacaactgcaaaatgggaaggtaacatcaacgtaaataaattaggtaaatatttgcagttaaactctgttcagagcgaagaagtagcaaacatctgcgattatttctcagaacagatgtcaagagccactacagccaagaaagataaagaagcaaaattgcgcaacgctgtatacggcaacttgaaacttatgagaaagacgctcagcgctgaacaatatgctaaatatgccgctttgatgaaccttactttactgaataaaggcatcgacctaagtaagtaaaattgaatcatatagcaagagaaagggtggagaccggtcaagttctccacccttctttttatctcatcccacctgccggactttattccggcaaatacattttcagcatcatttacaagtacaccggaatcatttgatagtcaccatggtagccccgaaaccatattcctgaaaagaggcatcctgataacggtaattgctgtgtttccgtttcaattcatcaataatggctttccgaagcactccgtctccttttccgtgaataaacacaactttctgctcacgcttctctttattcgcctctattacttcacggaatttgtccagttggtagttcagaatttcgctgttactcattccgtgcgtatcatcaagcagagaatcaatatgaaggtctacttcaataatcccattttttccgctctgaccgtggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcttcataataggctgcgacttgggtttatccacaaactttttctgcaacaaagctgactgaatctcttccgccgacacatatacctgcttggcaggcacgtcatctttcacaatatcataaatcagagcaggttcttcgaagaaatcggaagcactgaatgtatgcagtttatagaatttcaccgtatcaatcctcagctctacgctgacagcaggtttgatggcagcaggctttccatccttgaaagcgatcagctggacagctacccgttccatttcattcaatacatccttggtgaattcttccagtaacagtttggtattcggctctaccagtccatgtgaacggttgttccaagcctttccttccgcactcagataagtataatacagatagtaattgctgtcattcaccaaatatgcctcgaaaggagtagtcatcatcgctttggcatcttcgggcacataagccaaaaacacattcaacgtatcaccgccacgcacttccggctggcgctgtataaccggcatttccggtttggccggcttcgcgggttcctcctgcttcggagctgtcgcggcaggcttgcgttttatattgtaatcatccgcctcaatcacgacacattcacgtatcggcatcgggatatcaaaaccatccgcatcttccaccagtacaaagtcttttcctttgaatcctgttacgattccaccgcctacctcactgaggaaacgcaccttatctcctattttcattattgtatctcctattaaaattcaaacttaaaacgggtaacaaagatagggatttatatgaaaatacagtaactttgccgcaaaatataacggaacgattctcgtcccccattaacgacaagaccgatgaaagaacttattaaagtcatagcttttgatgcagacgacacgctgtggagtaacgaacctttttttcaggaagtggaaaaacagtatacggatttgctgaaaccgtatggcacctccaaagaaatctcagccgccttattccaaacagaaatgaataatctgcaaattttgggatatggcgccaaggcgtttaccatttcaatggtcgaaacagcattacagatcagcaacggaaagattgcagccgacattattcggcaaattgtcgatttagggaaatccttgttgaaaatgcctatcgaattacttccgggagtcaaggaaacgctgaaaacgctgaaagaaacgggaaaatacaagttggtagtagctacaaagggagatttgctggaccaggagaataagctggaacgttcgggattatctccttactttgaccatatcgaggtgatgtccgacaagacggaaaaagaatatctccggctattgagtattctgcaaatagctccttccgaacttttgatggtcggcaattcttttaaatcggatattcagccggtcttatctttaggtggatacggagtacatattccttttgaagtcatgtggaagcatgaagtaacggaaacgttcgcacacgaacgcttgaaacaggtgaaaagactcgatgatctgctatctttacttggataaatactctatctggataaatcccggataaattcaaggaatattacagcaatttcatcagctccgctgcccgacaggcttctatcgagttgccgacagaaagtttttccaaaatattctgtcggtggcggttgaccgtattcacactgatataaagagtcgctgctatttctttactcgacagccctttccgtatgcagcgcagtatttccttttcgcgttctgaaaggatattgcggtgctcttccgaaagggataatgtttctacttccccacgttccatctgggttatcgtagcataaatgccttgttccggccgttggtcggcagataaggaataaaggcagaagatcagccaaacattgccggcaggggtgttctgcatgatttgcacaaggttgtcaatgtattgataaacgcctttttcattcatcatacgcagtctgcatctgccccgatatttcagccgttcgccgggagacatggaaaaagtcttctggaaaaacttgtattccatcaaacgcttttctaccaaatcttccggatgaatgcgccggtagatacaatcttcgtccatcgaatcaattacgcttaaagccgcctcttcgggagtaagtcccaggaaattcgcccacggatggacagtaacgtaacttttccggttcgaaagatcggaaatgacagcacaccctccattaacttccgtcaatgagcggacaaactgctggtgttgttccactattccattatccagtgcttcgtgcgctgtcggatgcgtagcatagacttcatctatttccttttgtagtacgtccatcgtataaaatggttattattcagtattgtcgcaaggacaggcatgacctatctttgcaccacaaagataaataaataagaaaagaacatgaaacatttaaaaatcaaaatcatgtcaatcgcgttattggcggcagcaacttcttctatggcacaaagtttggacaaaatgaactggctgaatgagcctcagcaatgggaaataaaagaaggcaaggctttagtgatggacgttccggcgaaaaccgatttctggcggatttcccactacggatttacggtagacgacggacctttctactatgctacttatggcggagagttcgaagtgaaagtaaagattaccggaaactatgtgactactttcgaccaaatgggattgatgttgcgcatcgatcatgagaactggataaaggcaggggtagagtacgtagacggcaaacagaatgtaagtgccgtagtcacccaccgcaccagcgactggagtgtagtgcaactgccggatgctcctcgttctttatggattaaagcggtccgccgactggatgcagtggagattttcttctcccgcgatgataaggaatatacgatgatacgtacttgctggttgcaggataattgtccggttatggtcggattaatgggagcctgcccggacggaaagggattcacggccacattcgaagaatttaaggtaactcctttggcagatcagcggagactggaatgggctaaaaaacaagccgacaaataaagaaagacagttcttccaacaagctcccttagatggcggagcaaaatgatggtacacaatcacacttcacggacagtcttgttgagccaatcaatagcgattcactcagaacaattaccctttagggagatgtatggctaaacaagtattccatcagccaaaatgatcgtcattcttggctattttcttccgttgcacctaggtacaacaattgtctcaccttggttaaacaactgaagcacctaggtgactctttcgtctcacctaggtgcaacgaaaaaaaaatcgctatttatgtgattaatgagtaactatcgtcggctaatggatagtaacagaacccagttccgtatcctaacggaactttccactaaacactcccactttaccgatgtcccatagagctatttttccaaaaaacgggtaaatttctgccgctcccgttccaacgtttcttcattcatatcggccacctgcctgaaccatgaatacttcaggtccacacttttcttcttcaccgatttatcccagtttcctatgacctgcccgttatgaaggacaatcggaaagaacaatccgttattagtaaacgctttggaataatgttcaaggggcagaacatccgtccggtctttatatcccagcagatattcatcataagaaggcaaaagatgtatatgccccgacagtttgccacgagtccggcagatgtcatgaatataccatgtctgttccttccattgttcggttatcagttccgaagcaatcagataaacagcctgttttgcatccgaaaccgacagccctgaccaccaaatgaaatcctgcaaaactgccggagaatggctacggaaataactccgtgccaagcgcgccaaagactcgtctttcgtcagttcgggcatcggcggaacccgttcttccaaaagtgcgtacgtgcatttgcttcctctgtcctcgccactacaaatgatgccttcctgctccgcacgtgccataaagcgagtcatacggcgattgtccgccacaatccccgaacggttaaagtgttcggcaatctcttgttttgtcagacttttctttccacaaagaatcttctccaacaggtcatgcgctttcgtatagagttcattcgggatgtccagatcatatcctttcgcaaaagaatcatttgccgaaataatacgttgcgcggaaagtttcagcatccagcggatatcctctgccgccaccagatgccacgtaggacgcatcacatgagtcctcagaatttctccctcacgcaacgccttctctactgtttgaattgtagccgatttcagacgcatccctactgcccacttcaccatggaatagttctgtgcctgcatggctcccatccaagacaccaactctttaggttcacggaaaagtggatttaataactgctgattcagtaaacggatattcggtatattcataaattagttattttatttgccacaaatataaaatcttttcgctaacaaatcattataaatgattaattgataagcagaaagaactttttttatccgccggacaggaattaaatatcattttctatttcttcttttgtaagaataatcccccgtcatacgactaactctccaaaatacattaaaatttaaatgaagtggaagaagaatttatcgaactaatcaatcagtatcaagggatattgcagaaaatatgcaatatctatttctaccagcatccgttccgtgaggattattatcaagagatattaatccggctgtggaaagcataccccaaattcaagcaggagagcaccgtttcgacatggctctacagagtcacgctgaacactgccatcgatcttgtgcggaaagaatctgtgcagcccgtttacaaagagttatcgacacaggaatatgccatacatgacagccatccagaagagaacaccgcaacggataaaaaagagcagctatatcaagccatcaaccggttgtccgaaatagaaaaagcgattatcattctttatcttgaaagctatgaatacaaagagattgccgccgttatcggcatttccgagagtaatgtcggagtaaaaattaatagaatcaagaaacaactcattaaacaattaaacaatggaagacaataatttgaaagaatgctggaaagaaatacataccggcacagaaataaagccaatgaatataaaagaagtgatacgcaagaagcattgtcgtaccatttcccaaaccttacgtcgtcagaaaacgttgatctctttatttgccatcctgctggcattctccgtagctgccagtatctgggatacgatcatcatgggaagcgcctcgatctccctatgggccggaagtgcctttctgctgtttctgctggtttcggccattggacattatcagctcctcacaaggtcagcagacacatattcactgaaagaatccggagcaatgctcaaaaaacagctggaacgaagaatcaatattgatttcatcatatatctgatattcttttacggaacagccgtcaggttcgtgattcaatatttcaatgattacgaaggattaaaagggcttacattcattctgatgctctttacgggcatccttcttgccattccatggctcatgaggtatcagcagaaacatcggtacagatattatttcaactctctcgataagagtcagaagctgttggaagtctccgaataaatctctacttttgtactccataacaaagaatatacttagaatgatgctctataaacttatttccccttccatggtaaaggcaacaatccagttgccagcttccaaaagtatcagcaaccgtgcactcatcatcaatgcgctgggtaaaggcatttatccgccggaaaacctgtccgattgcgatgatacccaagtcatgataaaagccctgaccgaaggtaaagagactatagacatcatggcagccggaaccgccatgcgtttcctgaccgcttatctgagtgccacttcgggagaacggattatcacaggcaccgcccgtatgcagcaacgcccgatacagattctggtcaacgcccttcgcgagttgggagctgaaatagagtacacccataacgaaggatatccgcctcttcgcatcaagggcgcagagctgaaaggaaatgaaatcacgctgaagggaaacgtcagttcacagtatatatccgccctgctgatgataggtcctgtgctcaaagacggactgacactgcacttgacaggagaaatcatttcccgtccttatatcaatctgacactgcaattaatgcaggacttcggagcaaaagcggcatggacttcacccagcagcatctccgtagctccgcaaccgtatcagagtgtccccttcaccgtagaaagcgactggagcgctgcttcttactggtatcagattgccgctttgtctccggaagcagagattgaactgttgggattattccgcaacagttatcagggagacagtcggggagcggaagttttctcccgtctggggatcacgacggagttcactcccaaaggcgtaaagatcaaaaaaacaggcaagacaccggaacgactggaagaagacttcgttgacattccggacctggcacaaacgttcgttgtaacttgcgctttattaaatatccctttccgtttcacaggcttgcagagtctgaaaataaaggaaacagaccgcatcgccgcattgagaaccgaacttaaaaagctgggatacctcatcgaagaagaaaatgacagcgtattgatgtggaacggcgaacgttgcgaaccggaagcggttcctgtgattgcgacctacgaagaccaccggatggcgatggcattcgcaccggcagtaatcaccttccctaagctgctgattgctgacccgcaagttgtttccaaatcgtatcccggttattgggaggatttgaaacttgccggattccaagtgataaacgaaggttaatcattgtcgtactgtggaagatttcaataaatatacttcccatatcaactattcccctattgtagattttacattacagcagggaaaagagacttcttataaaaaaggagagtactttgtacggcaaggagaagcctgtaagatcatgggatttgttgtttccggctctttccgctattgttgcgtcaacagtctgggcgaaagcagcattgtcggatatacattcgaccattcttttgtcgggaattatccggctttccagttgcaggaccaatcaaatgtagatattcaagcgttatgcgactgtacggtgtatgtgatcaaccattcccaactggcagatttctacgacattaacaacgaccaccaaaaactgggacgccggattgcggaaactcttctgtgggaaatatatgatcggatgatctccatgtacagtctgacaccggaagaacgttatctggatattatcaaccgctgtcctgacctgctgaaactgattactttaaaagaacttgcctcctatctcctgattcgtccggaaacattgagccgcatccggagaaaagtagttcggaagtaaattcttgatttcaatcaagattttattcagactcctcccctacctttgcaggcaaacatagtctattttaattcatgaagaaaataataattgtaggcgcaacctccggcatcggtcgtggattggcagaacagtatgcccgtgaagactgccttatcggtatcaccggtcgccgtgagaatctattaaaagagatttgcgcacaagataaagataaactattctatcaggtatgtgacatcactcacacagaaacgccccttttatcactggaaacgcttgtacaagaaatgggaggcatggatatgctgattatctgtgccggaacgggggaactgaatccgcagctctcctatcagctcgaagaaccgaccttattgaccaacgtagtgggatttaccaatatcgccggctgggggttccggtactttgaacagcagaaaggcgggcatctgattaacatttcctcagtaggcggaacacgcggcagcggtgtagcaccagcttataatgcttcaaaagcctatcaaatcaattacatggagggacttcggcaaaaggcggcaaagctaccctttgctgtctacaccactgacatccgtccgggatttatagatacagcgatggcgaaaggagaaggattgttttgggttactcctgtcgataaagccgtaaaacaaatcaaaaaggctatatcagacaggaaaaaagtcgcctttatctccaaaagatggaaatatgtggcatggttattcaaactgattccttccgccctttattgcaagatgtaaaacagcctttcagtgaggctgagttaccatgaagcttcattggccatcttccacatattaagaaaagaagccttggtgatttccactatcttatcccagtttaaccggtcagcatgatcggatggctggtgataatcgggatgtccgtccgtatgataccagataataggaatacctgctttggcaaacgttccattgtcactgccccctaccggattgtcccaggcacgatagtccggttccaactgtaaaccatacttcttaatatcctttttcagccagtctccaaaagagggatgagcagctgtatagaaatagacgacatgtttcggttgttccggtttattgttgcgacctatcatatcaaagttgagatatcccttgatctgcgaaacaaaagggcaagtctgtacaaaatatttagaaccgagcaatcccttttcttctccgtcccaaaaggcaaagattacatttcgctccggttgttgtccgcttgcaagaaatgcccgggcaatctgcaatacagccgagacaccggaagcattgtcatccgcgccgttataaatctgatctccgtcaagtgccgggtctatccccaaatggtcaaagtgagcgcctacgatgacatattccttcgtattcttaccgggaatcatagccagtacgttcctcatagatagtttttgatgaacttcctgtttcagcttcgctacagagtccggatgaacttccagacgtcctttcttctgacgctctttgcggtaagcatcaaaaggctggaagtagctttcgttcagaggttggattcccatccattgtaagatagatgctatatactcagaggagacatacgaaccgtggaatccggcttcacgtccctgtaattcatcacttgcaaggaaaccgattgttgcttcggcagaagaacggttgatcgtgttcaagcccttttcttcgggagactgtgcaaaagttactgttcctacaagtattaatccgaataatataattctttgtttcatcgtggtatataatttagagtccatgttacaaaagtacgaaaagaacacagaatctatccttaaatacaaaaaaagagtaagcagttgccatcttttataagatttggctgctcactctttctacaaactattaagaccttgttatcctgtcaatctttccttattttgaaaaaggagacatgcggaaagcatatttataaactgtattcttctgaatttcataagcgggacggggacccggtccgcaactggcattacccagaccacgctgtatgcaatccagattcagcaccacctccgcacgataaatatcaggcaaggcatgaccgtacttgatttcaaacaagtccttatccgtatagtgcaaagcactgaaatcaaatgtatcggcagcagtaatcttgattcctttacctgctttattggtcaaagtcagccagcgggtatcacaacgcccacccatcgtctgagaacgggcataactctctttcatatcattgacagcagactggtatttgccgacataagccgcattcttccgatcccgataattttctatcggaccgcgaccataccattccaactgctccaacgaaggattaaagaaggcctgtaacgacagacggggaagattaaagtcatcattcgttgtaaaagaagcatccacatctatttcaccattaccatacaaacggtaaatcaatgtataaggcactttcacatctccgacggtttcctgcaactgaatcgttacaattgccgactgattatcttccgaccatttccagtcgaaactgattacctccgtttgggtatcctgccatttacgcacatcgttattgataaaacggaacgtattcagcgaccatccttcacgcagatgaagcatattatcgccattataacggataccggtcaacttgccttctttcttatcaaaggtgatttctacaccgggacggcggaagaacaaataacgcttctcctcttccaccaccttaaacagagattctttagatgaggcggaaactgctaccggctatagcccggtattcggggatttttgaagcaaaagttgttccgtagctacgatatgtccggcttttgcccatacgcaatccttctttagttttatttcaaggttcaaataatattcaccttctgaagttaaatagcgggaataaggtatctgcaccgcacgatgctctccaggcttaccatcgggtaggctgaactcttcttccgctatcggcacaccatctttcaaaatcacatagcgcagattaaaatcatgcagattcaggaaaacatagcggttacgaacgccgatactgttttcagcattcggttccaatgtgatatattggtagactttcttcacttcccacaacttaggagtaacttgacgatcagccgtcacaatcccgttacaacagaaatcattgtcgttagggcgatcaccgaagctgcctccaaaataataatgatcggcaggctgtccgggcatattaatgccctgatccacccaatcccagatgcatcctccgatcatacgtttcgaatgatgctcgatataatcccagtattcttccagattaccgatggcgttgcccatcgcatgagcatattcacaaaggaaataaggcttgttacggggttgctcgtcctgttcgatcatactttcaatcgaaggatacatacgggaatccatatcggccacatcgttcattccttcataatggatataacggtcgtctatcgctttggctgcctgataggtagcctcaaagttacgaccaccaccggactcattgcccattgaccagaaaatgaccgaaggatgattcttatcccgttccaccatacgcaccatccggtcgacgtaagctccttcccaactttcacggtttgacagcgacatattgccgtgacactcaatatcggcctcatccatgacgtacaagccataataatcatacagcgaatacatcttcggatcgttcggataatgactggtacgaatcgtgttgagattgaaacgcttaaagagaagaatgtcctctatcatgctttccaccggaacagcttttccaaactgcggatgtatgtcatgccggttggctcctttaaaaaggatcaatgcattgttgatatacaccttattattccggatctctatcttacggaaaccatattgctggctcgtcgcttcaagcacattgcctgcggcatcaagcagttccagttggacggtatacagagaaggagtctcagcactccataaccgagggtcgcgaatcgtagtcgtaccttcacagacgttttcctgtccaccagttatcttaccggtaggtatgataaacgaactcacaggctttccttccgtattcagcaaagagacacgtacggtagcttcctgtactttctttccgtaattatgcacatccgttttcactttcagttccgctttatccagacggtcgctgatctgagaagtcaggtgaatgtcacgtagacgaactttcggactggctaccaaataaacatcccgatgaataccacttaaacggaacatatcctgatcttcaaggaaactgccgtcacaccagcggtaaacttctacggcaaccgtattattacccgctttgacgtaaggagtgatacgaaattctgcatcattactggacccttgcgaataaccgactttcttaccgttgatccatacataagctgcactataaattccatcgaaatggataaagacttctttgtctttccagtcggcaggaagagcaaattcacggcgataagatcctaccgcattcggctctttctctacagcatatccacgctgcccctgtataaaaggaggattgttacggatgggataagtaatattggtataaataggtgtaccatatccgtgcatctcccagttggagggaacaggaatctctttccagccagagacatcataactcgttttatagaaatccaccggacgttccgaaggttgtttcacccagttaaacttccagtttccattcaacagcagataacgggaagagcgggtacgctcccaaggacgggtataagcgggatccgccttcatctcttccgaattggcgaaaggaataaatgtagccctgccttcttctttattgattgcatagatacgttcattttcccagtcattatgactcgttgttttcaaggcttccgccactactttcaggttcgatttccgtatctgccactgctggttacttttcgaagcttccggttctaactgaaagacaggctctccgaccagtccggcatcaggaaatcctaagttatagccagtcccgacattggttaatacgtaattcccattcggcaaagccgttattttccattgctggttcggatttttagggtctgccgaccattgaatcacggaacattctacttttcctttaccactattatctacattcatttgagtcaagggactggttatcgtatagcatccctcttgttcgcatggaatcaggttccagacctgcgattctttgtctgcctcccgcttactgataaatattttcgtattcgtatccagactctcctgattgtctagcactaatccgttgaccgtatggatttcatatccttgcttcggatcaaactgctgcgccacaaccgcagaggcggaaaacgacagtgcaatcaatgcacttcccaagatttttaatcgttgcatcatttagtagtctaatttatattataatttgaaaaccggtgactgtttatatacgccaaaagtatggatagccggacaagccttaccgtcctgaatacgcaaacgtacctgctttgctttcaccggtgccagacgtacaatccatttatgaccaatggcctgcttgtccgtcgcctccggaatggtgatccagtttttgccatcaacagtgtactccacactccacttcgtcgtccgatgtcccaattcgataacttcttcgatcatcagacaatcaaactcaatagttttgggcaaggtaaaaattatatccgcttttacctctccgtcttttccggcaaaataagtgtttttctcattgtccagcattttttccggactatactttgcaccccgtacattggtcgctttcactttggctcctctcaacagattcgtactgaaagtctcatcaatcccctgttttaacaaggcggcgtgcagcgaatcggtcgaatgaatcaaaccacgtctgtcgggcgggaaattcagaagcaatacactattacgccccacggaggtacagtagatatcccaaagttcacggacactcttcacacggctatcctcttcggcatgatagaaccagctgggacgtattgaaacatctgtttctgccggaatatacgcatcaccatccagcataccctcattcaaacctttgtaatactgagcttcatcacgaatagctactgagtcagtcgtcgcccaacaaggatcacccgcttctcccgcttcattccccatccagcggacatcagcaaacggataagaattctttgtaccgaagataacgcaatccggctgtttttcacggacaatcttataccaatgacgataaacaggcgttgtcaattcgtcggctcccgcgccgtcccaccatgtttcccatatcttaccgtaatcactcatcagttcgccaagctggtgggcataatattccttgtagcgttcggtcgtatataaaggtgaaaggtgttcgtgacggtcatgaggtcccagatagattcctgccttcaatccatactcttcacaagcatcgacaaactcgcggactacatctcctttaccgttcttccacgctgcattcttcacactataatctgtgtacttgctaggccacaagcaaaatccgtcggcatgcttggcagtcagaatagcagcgggaatccccgctgcttttaatgtctgcatccactgcctgcaatccagggctgtgggattgaaaattgccgtacttgccttcccgtcaccttcattcacatattcttcaaatgtattgattccaaaatgaaagaaagcaatcatctcccgattgtaccattcaagttgacgggcactcggaaccaacccgcaaggagctggtgcttgttgagctatgaccggcagagaactgaatgcagcaactgccgatgcaactaatacttttatgttcataataaataacttacgagtatattcgtttatttaggacccagattttgtttcaccagctgcacgaattgatcgaccggaacaacacgcacattgtcattcaatccatcaatgacggttttgatactttgctggttctttgtccagcaatgtacaaatacaaaagtatatccgtcggcactatgcggattggcagagcggctattgatctgagaaatgacagtcgattcttcacctctgttcgagccaccgtcgatgccttcccataatacgcttctctgctcaatcaccggcttgccattatccgaaaatttgattcttccatcccctttttctccatatcctgtgtagaaaatcgcatcgatattaggctgagccagatacttattgtaaactttcggattatccataatcttctgatccagaatattacagatattcaagcctgacttatcgacatactcattcaacttagccagataatcgtccaggtcggcatccgacatcttactcgggaatatatagctgctgccactcggacccgctacaaagtaatcgccttctttgctattctcatagtaccagcgtaaagcagccggagccaaatcgtacagagaaggtgaaatggtatatccgagtgggaattgaccgtgcaggtcatgatccatgtatccttgttgcccccaaaggttaaacgcaatattatcaccgtcactgacgaggaatgtcacatagtgcacattctcttcggtaaccacttctttagttgccggacgctgtttcagtcctgttgtatcatatatactactcaacgtggccagattagccgcctgatcggtcggcaacatagaaacacccaattgagaagcattattcaccatgccccattcatccagatcataataaccgaaacaataagctcctttatccagatctttcagtatagaagtacgccatgaccaatccctgcgcgcattgtagtcataaaaagcaaaagcattggtcattgtgatataatcgcgcaggtgatggaagatttccggtttcatatcggctgcaagactcttgtccaactggtctttataattctcgtacaaccacttctcatcataagaccttacgtccataagttcggttgtcactcccattgcctttaccttatcgacaagagattccggtaccgcaatcccccgaagcaacccacataaagaagtagctacattgatcgaatgagattgtccttccgaataaggcgtatagacaatataccccttgatcactccggtttctacataatgctgtaccaacggagccaaagcattataagtatttaccggaattccgtacttattctgcatctgcttcaaccatacggaagaaggacctccttcattgatataaacctgatcgcccgtcactcttgccgcaagccctgccaaagtggaaagaattactttctcgccatcattcagtcctgtgatggaaatagaattcagggatttcagttcacgacctttcagatgcataaatcccctgtccagcggttctgccggatctatcagcccatcacccggttcttcacccggacctcccggattctcggtagacggagtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggaacgaccacacctgccgtcggatcttccatacaggagattaacagacagaacgtcaaaagtatataaatgtattttttcatggtaatcgttttttctgttatttaataatagaaatcgcattaatctctgctaccactgttgcccatttgccactatacacggcagttattgtcagacggaaataacgtgcctgcttaaatcccggaaaataggaacggaattcctcttttgcccccgcaggaaggtcgctgtaagttcctgccgactcccacttcgagccatccagactggtttccatcgtcatctcctgcggccatgcttcaccatgatctctggatacatactgaaagcccagcattttcacttcctgccccatatctactacgatatgatgtggtggctgaggctcgttgcctttccattgtgtatgccagaaagttcctttcagtccgtcaaaagcgtggatagcgtgaccgttatccgacccttcgccgctcgtctcttccgaagaaacttctactacctgccatgcactgcggtcggccaatggcatcgcccatacatcctccgcaccactcaaaaggtaatatactgtctgctgaatatgatccgcctgcgcaccttctaccgaagtgatagtgaccggcaacaaataagaatcaaacggctggatttttccctgtgcatttaccgtaagcaccagatcggcagaagaactctccccggccggaatcacagtttctgttgtcagcgtatagcaatcggaaggaagcaaaggatagtctgtcccacacaaagaattatactcctgcaccttcgcctcatccacagtcaactgtacctttacatctcctcccacttccttaccggaacgggtcacatagtcactggcagtcacagccacatgaaatacttctctcagttcttcacccaaatcgaagtttttaatctgcaaagttttggcttccggaatatatactttacaaacatcatcatcactacatccactcagcaaggcaaacgaacaaagtaccgcacttgccgccatgacaaatctatttagtttcatacgaataatctttcaaggtttacattctttattaatatccgggattctgcccgtttacccatccgtcttcaccaccattttgctcgcggatcaccggattcttgtctatcacatactgcggaatgggctgataatacatacgtggcaggaaggtacgtttaccaacttcatgataattgtattcccacacaccatctccattggtatcttctatcttcataccaccaatcggtttattcatcactccgttttcaccatcacaaatcttccagcgaagaatgtcccaccaacgcttatcttcaaatgccaattctatacggcgatctctccgaatgatttcccgcaactgattttctgtgattccctgcggataagtatcgccgatagaaggcatattatctccacgtgttctcaccatatccagatattcgatggcagtcggtttatctcccgcttccaaagaagcttctgcatacatcagcaacacatctgcataacggaagaaaatataatttgccattccgttgctcatttgcagattgtccgctccattcacggattcatcaatcgttttacgagtgtagtatcccgtattcgtaacgtcactatccgaagaagtatcaatctcattgggactacctactcctacacgagtaataatctcttccccctgccacatagatccatcatacaggatgctctggtagaagcgtttctcacgatttttataaggattattcttattgtaaccggatgcaggatcagtgataggcaatccgttggccatgcaatagtcgtcaaccagttcctgtgtaggctgcatatttccccaactggactgtactccttttacaaacaccggaccgaacagaccttcacgacgccctccattctgcttagacatctggaagtcgaagatcacttcatcgttattgttggtagcttctgtccaaaggtccaaaatagtcggttgcagatgatagacctgtaagtcaattacatctttcaaggtagccgcagctgcttcccagcgtttcttgtctttgcccggattacgcaattcactggcatgaaacagttccacccatcctttcagtgtcagaattgctcctttggaagcacgccccagatcggaaccgctacggcgcggaggaagatcatctttaatctcgtccaactctttgtcgataaactcaaatgttttctgtgcagtctcacgcggataaaagatatccgtactcacgttattatccagcacttccgtgatgataggcacaccaccgtacgccatccaaagatagtgatagaaccaggcacgcaggaaacgcacttctgcaaggcgttctttcttatattctgccgagaaatcggattctgttactttcgtaatgaaaagattgcaggaacggatacgctcatactgtcctttggcgtcgtcattattctgacgtccccatttccacatatcccaggggccgggtatccagctggtaggagataatgctccggtataaatcgttgtacgggcattcatccattccgcacctacgtatgaattatccgaatattggtccagattctgtgtttcattgttcagatgcggcaactgattatagatatcattcagaaacatatcggcattttcttccgatccccagaccgttgtatctccaaaacggtctttcggctctatttcaagccagtcttcacaggcagacagcaaggctaatgagcctgccaggcaaactgtttttattatattatgtattctcatattctatcttgttatgatggttaactaattaaaaagtaatattcaaaccaaaagcatatacagcctgctgcatatagtatttaccattagcggatttggcttccgggtcgatcagctctttcataaacggagtccatgtccagaggttttgtccggaagcatatacacgggcagagctgataccaataaagttcagtgccgaacgaggcaaggtataaccgatttcaatactcttcaaacggatataagtagcatcacgtacccaccacgaagaaggttgacgatggttattcaccgttacttcactggtcagacggggataaggtgcgttcgtgttatccggcgtccagtgatcactgaattgtaacttagtagccgaaccggaatcaaagaaaggcattaccaaagtctcacccaatgagatactggtacgggtagccccttgaatcaatgcgttcaggtcgaagttcttccattggacagtaggagccagaccgaaaataatttcgggcgcccagttagagaagccgatcactgtctggtcgtgttcgtcaatctttccatcaggcacgccgttaggaccgcttaaatcttcgtagcgcaaatcacccggatatacctgtccccaaggttgagtagcgatgccggcctttaaggaaccgtcaggattgaagtcgtcataagtaaagtaccccaaagcattgtatccgaacattgttccgtcgggacgtcctgttctgcgacgattcggattattaaaggtggcttccgtctcaaatacttcatccagaatattacgtgcgaaagtgaaagtaccttttgcactgatcatccagtctttgccgatacgtttgttgaaattcagagataaatcaataccttgattgtgcatacttcccgcattgacctgtgacaaaggaataccatattctgccggaaccaatgcattcggagccatcagcatattcgaacgcttctcatagaaatagtcagcttccagagaaaacataccgttcaatacggaaaactccacaccgaagtcaaacttcttagctttctcccaagtaatgttcgggttcccctgcaagttctcccacatacccatcataggtacaccgccaaagtttacagcgtttccgaatccgtaatcactcatatattgataggaactaccagccaaatttccggactcaccataagaaagacgcaatttcagtttatccatccattcgacatctttcataaaggattcttcccgcaagttccatcccagtgagaaagcagggaagaaaccaaaacgtttgcctggagcaaaatagtagtgtccgtcataacgaccggaaacttccgccatataacggttatcataattatatcccaaacggaatgcataacctacctgacgttctttccaagacgtaccaccgttgctgatatcggcagggtcactgcttcccgcattgatttcatctatgttaatattataattcagacgtttggcactcatattccatacgtttctttcgcgtgcttcaataactccgagtccagtaaccgtatgcttgccgaaagtccgtgagtaattaatcattccctgataagtcatgctcacgctttcttcaaacgattgttccagattcggtttctccggtccctggaatccttccacgaattgatacggagtttgtgatgcatccagtgtgtatacaggtatcggtgtcagatatttctttttcttcacacgatacggatcgtagttgattactcctttgatgcttaacccttgaatgaagggaagctgttgctctatggagagagaagtattcagttggtcggccggctcctgacgatatccgctacgataggtcagcccgaaaagtgacttacctacatattgtccccacagaccattcgagtactgtatagcagagataggaggtgtacgatatgcctgatacatgatgtcgcctgtatcggcacccggataattcttcttttcgtgccatccacccagacttaaactgattttcgtatatttggtggcatccacgcttaaattagccagcagattaaaacgctggtaatcggtagtactccacattccttcctgataagaatatcctaaagatacgtagtactggaatttatcgctaccaccggataattgcaagttgtgattcgtaatcacagaattgttttgtaccaagtcacgcagaccgttgctattaggataacggtcaggatcggcatcggggtctccggcacaggttttccggtacatttccagatcatgctgtgagtaggcataataattgggataacctgcattcatagccgcttcgtttttcatcaaagcatattcatacgaattaacctggtcagtgatgcgggtcgggttctgaaaaccgatatatccattgtatgaaagtaccggagcaccgctttttcccttttttgttgttaccaatactaccccattggcaccggccataccataaggagctacggcagctgcatctttcaggatagtaatatcctcgatcatattcggatcgatacgtgaaaagtcacggggaactccatccactacgaccaatggagattggttccctaatgtagccacaccacggattctcaaatcagaaccatcagctcccggttctcccgatccttgttttgcaatgactcccgccatacgacctgccaaactattagaaatattgataaccggcttttgcgctacatctttagtcttcatgcttgatacagcagctgtagaagaaatcttcttctgcgtaccgtaagccacaaccactacttcttccagaatttcagaatcttcttccatcacaatctgaatggcattctgattgttcaccggaatattctttgtggaaaaacccacatacgtaaccgctaataccgaattggaaggcaaggataacgtgaatttaccatcgatatctgtgatcgtaccattagaagcacttccctgctccatgatgttagctccgataataggctcgccacttttgtctactacggttcctttgactattatttttttacctattgattttttctctacctgcgttttcttcaatgagatgtagttgtcggcgtattcatacgtcagccctatttgcggcaatacattttcaagcaatgcttttacctgtttattccgggcattgatttttactttctgttcgatattgatgtcttttccgtagacaaacaaatatccggcctgtttttcgacttcttgaatcagttcttttagcgaaaccgaagttttattaatattcacaactgctgtctgtgcctgggcctggtatgtaaaaaggttaataaacaggaccaaagcgagcagtgaaaagatttttttcataactttgctaagtggttttgttagtactttattttaggttcacaaaaacgtgaaacagagaaagtattaatagctgaggaattggggagagtgttgcaccactttccccctttttattcctcattttgatgtctatttactttcgttttattctactccgttgtgttacataggcattaaattttaatcagattattaatatatcgttatctctcgctgtgacagtattttgtactcaaataagtccgcacggctaattgctttcagaatcgtttcaatctgatcgctttgccggaacttacccgaaataatcttactcaacagagatggatcatctacagtaaaatgaatatcataccattgctccaatctttccagcacttcgcccaacggtaattcttcaaagtcataaattccttgttcacgatattcctttcctccaaaatgagaagaagactttaccagttttccatctaccaaagatactttctcgtcaggcaataaattcaccgattcttctggaaatccggtagagctaaccctcactttacccgagagcaagtctgtctcaaacttctcactgttactataagcatacacattaaattccgtaccaagcactcttacatcatacttctgcgtctgcactgtaaaaggacgggaagcatcctttgtcacagtgaaaaacccctctccatccagttctaccgtacgggcatcggacgaaaaaacagaaggccacttcaacgtagaaagcgaactcaaccatgcctcactaccatccggaagggttaaatgtacccgttgccctttcggaactgtaatctccgtataagaaggagtctccgagccaacaaacatataccaggcgagcatccacgtcagagcaatcatagcggctgccgaagtagtataccgcacgatttgcaacacccgtttccgcctcagctttttctcctgacggttcatcattgcttccagattccgttcgcctttcaaagaatcatcttctctgggtaataatccggacagacctacgatattttgcatttctgcaaattcccgtttcatatcttcgttcttttccagttcctgaaaaagctcccgtttttcctcttcggtcggttctccgaaaaagtattgattccatttctcattcatcatattgcgcgcttttaataagaagacacagcaacttacatttaccaccaaaggaaaatgaaaaaaaatcaaggaagggaagtaaaatccaataagtttaagctaagaactgttttgaaacgaactaatctgttcggatttactctaagatttaattcttgatgtacacagatttagtattcattatacttaaatttaatcgtctgacagttgttgaactttcgtctgacagttgttagacgaaagttcaacaactgtcagacgaaagttcaacaactgtcagacgaatagatttataagcaaccggaactaaattcattcattataagctgcaaattagtactcagcttgactaaagtatatggaatggactgaagcaaagacaatacataggcgatttatccttatacgctcaatagaagcagcaaaggcatacaatgacgcaattcttcccgaagtttcctcaaagcgatagccatttgaccttctaccgtattctgcgaaatgccaagggattcggctatttcacgatatttcatacccttcagcttactcatgacaaatatttcccggcaacgttccggtaagctatcaattgcacggcagatctgtttttctacttcatctatcgacatttgagagtcatcaagtagttgcagactataaagtttcagtttaaactcctgctccataatatcagaaagcggctgcctgcggtctactatagaaagttgtgaacgaaggaagttcagacagcgatgcttgacagcggagaaaagatatgcatcgggctgttgcagttccggaagtatctctttacgttcccataaatagaggaaaaaatcttgtactatattctctgcgtctcccatagctcctacataaagggaagcgaaacgaaccaaacgggcatagtaggaaacataaagctttgagaaaagcttttgtgccgtcaagggttcggaagatggaagagaatgtatcataaacctcatattagatgcacaaaggtaacaaaagaaacagcaaagacaaagcctgactttaaattcctattgtatgaccgatacagatcaaatcaattaagattctctccgtatcggtcaatgaaaagtatactaaaacctattgaaactacttggaataagaatatgggaagtctgccggttgggtacctctttgctgattcggtacgctgtccatcgacagattcagttctccgccctgtttcagttcatcatgcgtcagatagttgcgtgtgaattcttgtccattcaacagagctttccttatgtatggacggtctgccgcattatctgctgctgaaacgacgaagtttttcccttcgggaagatgcagagttacctttttaaataatggagaacctatcgcatattcaggcattcccggacaaaccggatagaaacccatagcagaaaatacataccaggcagatgtctgcccgttgtcctcgtcgccacagtatcctttacttccggaattgtaaagtttgtccataacattacggagatggtactgtgttttccagggctgaccgatataatcatacaagtaaatggcatgctgcaccggttggttaccatgcgcgtattgtcccatattcaaggcaaccatctcagctatttcgtggataacgaaaccataggttccatagttataggtgttcggagccacaaacatagagtcgagtcgggctatcatcggttcatgtccgcccatcaattcggataagccttccggatcatgaaacacactccaagtccagtgccaggaacttccttctgtgaaaggaccgccccattccgtagcatcaaaacgatcacgccagttgcctttggcatcttttgtccacataaaaccatgttccggataatagagattgcggtaatttggggctttctggtaatactggtctgcgatatcctgtttgcccagcgattccgcaaagcgggcaatacaccagtcagcataagcatattcgagtgttttggctgtagcttcgggaacttccggataaggtacataaccgagcttatcataatactcgaagccgtcacgccctacagaagctatttccgcatgacgggcttgtgtctgatgaatcatcgcttccagagctttttcggcatctaccgtttgtatccccttcatccatgcatcgactaataaggaaacagagttattgccaatcatacaaccacgatgaccgggactcgcccattcgggcataaagccactttcattataagcattaatgatagattgcgtcacacgttccgaaacttccggatatagcaatgtgaataacggatgaaccgcacggaacgtatcccagaaaccattgtcagtatacatataaccatcatgcacgttaccgtcataaggactgtaataaacaggatttccttgtgaatcaaactcatagaactcacgtggaaaaagtaatgtacgatacaggcaggaatagaaggtacgaagttgttcgtctgttcctccttccgcttctacacgtccgagatagttattccactgttcacgggctttcccgctgatcagttgtacatccgcatcagctacttcacgattaaagttgatggcagcctgttcgggactgataaaagaagaggctgtacgtatggtcagcttttcacctgccggaacatcaaatttcagataggcacaggtataatcggccgctacatcggtttgatggtgcaacaaagtatctccattgtaagtaccgtattctatgacgggatgactgaattccatcataaagtaattagcgaagttatccggcacacctccgttattataacgtgtcgcaccttttaccaaccgtttttccggttcaatcgttattgaacttcctccgttgtatgcatctaccactacatactgatcttccttttcggggaaagagacctcgaatacagctccgcgggaagtagcagaaagagacgtctgcaatccgttattgaatgtaacactgtagttataaggagtcgctttctcctgttgatgtgagaacggaaccagacgttctttgtgactcattttcagttctccggcaagcggcataatggaaaatgtaccatagtcatttatccagggactaggctgatgtgtctgccggaaaccgcgcatcagactgtcagtatacgtatacatccatccgctgccattctcccccgtctgcggactccagaagttcatcccccaaggtaccgccacagcaggataagtattaccatgcgaaaacgcaaaagtagactcggtacccatcaaaggattcacgtagtctacaaactctaccgtcttctttgactgctgacacgaagtgagcagaaaaggaaaacagattgataagaaaaacaatcttgtaaccatatctattattatttgcttaagtttcacaagccttctgtatcacttctccttccacgttaaaacagagaaaaccatgcagaaagcctgtgaaactcaggttaattaaaatacctcactcagatacttcttcgtctgttccggacgctggctcatacgcaaacgccacaccagttcctgcatatttacgacttcaaaactatcgttcagatgtcctgcacaaagctttgccgctccggctccacgaatatccccggactggttctcaatcagcgggtcttccgtctgtccgtgatcggagaaattactccatgcatgcacacatacgacagaaaaactttcctgctgtgcttcctgtttcaatcttccggcaatataggcaggggtaccttcacgttccgcattccggtttccaaaattccacaaagagtatttcaccgtaatggccgggatatcataccctgctttattcgttacccaaataatgtctccttcacctcctgcataaggactatactgaagcgctacgataccttccaactggtcattggcatctacataagcctgaaatgcttctttggcagcctctgattttacgttcatagccattacacccagcagtttcacacgatgttgacgcatatgcgccgaaaggcgttctgccacgactttcaaattcttcgcccggtcgccattctcgctataattgtctacgtaatagtaaccgcctcccagcatttccaaaatagagcaattcggcttttgctgactcagcagattatcgaattgtgccggtgccatcatcggaagcactgaagcagcaataccatacgtcatccgtacttcttccgactccgccgcattatagaaatctttaaagtcattcatcatccactgaatattgtcaccatcggaaaggaagaaagaaacgaaattctttttctttgtataatccagaaactgcggattcttcacgcgagccaatgtcgatttctgacgttgagaataaagcaatgaagtcaaggaatgattgtaactccagtcacaagggatcatcggatgaccgcttttggaaaccaaatcgacaaaagcatcttcacttactccctgttcccatccgtagacaggtgcattcggttccagccaggcaaggatttctttcagcaaagccgtattctgtccgccagccgaactgccctgacgcttattcaagttcaatacgaaaagttcattcttaatagcaaactcacgcaattcaccggtttgtacaggcatgatcaccaatgctttgttgctgcatttgtctttgaactccgcccatgcctgtgcagtagttttgcttcttgcatcatatttcatggtatatcctgcttcttcataatattccttgtcacggacatccacaataatagaattataaacatgagaagcaacggaagctacaacaccactctccggattatgctcaatatccgtcaagacatatccgtcaaacatacctttcagctgaatagtcactccgtcggacggaccataatcattacgtgccagttccagtccgctctgcatcccctgttcgtggatacccatatcttcgagtgcctgcttagacagtttataggaatcactgccaccgtgatcgtgcagccaaacagctatttcacttgttccctgttctacggcacgattagccagaccggctaatgactgacacatcaggtggtactgtaatccgcgtactttttctgtttgtcccagttcattacggctgcctaccgttacgacttccacacaattccagtatttcttcggtttcaccttcatttccggcatatagtattgacccacattactgatcggatcataagcatctgtataaagggacgtgttgttttcttcgttcaatccttgattgatttccggcgattcgtacacttcacaactagccattgtcaagctgagcaacagtgcagcaccacatatagtcattttcataattatttctttcatttgttagttaaccattaatcaataaccttcattctgcgataatccatctaccttgttccgttcatcttgcggaatggggcgtaccagatggttcttgttcaaattatcatacttcaccacaaacggattgtatgcaggtacacgtgtcagcaatgtctgagtacgtttcaagtcaaaccagcggtcatgctctcccatcaactcacgggcacgttcatccatgataacgtttatatccagatctgtcagcttcattgcttcataagcggtcgcatctttagcggcacgcttacgtatactgttgatgcgttccaatgccaatttcttgtttccggcacccagataagcctcagcacacaacagataggtatcacccaagcggaaaatgacatcttcacgagaaccgccttcgccccattgtatcttggtatcgctgaacttacgtaccatcggcatacgatctgaagcagtttctaatacaggaagtgccgtagattgcggataccacacatattcatcgtcctgcttgaacggataaaaccttttcgcgttattactcatacccgatttatcgttccaacgggggaaatagattcccagcttaccgtaatcagcattatccggattgtttatgtaatattcacgtttgaacgtcgcatcataacgggtatccgcttccgggtcggtataaagctcgtgcgctttcggattcacccagtatttacgggaaacactagagtaatcattctgattcttaatgaacagatccggctccaatgctacaatattaaatccgaactgtgcctgttgcggatttccatccccccgatagttcttatccagtccatattgaatcgcccagatcacttccgaattagcctgattgttttcatcgaacaaagcagcatagttttcctgcaaagcataaccggaggccggattctctaccagcaaatcaaatgtcgttgctgcattggagaagtcgtctgtttcagcaaaggatttgtaagcacgtgtcagatacattttccctaaaaagtgaatgactgcggcattcgttacctttccggctgaaatcgtggtcatgtccagtttatcctttatatcattcagttcggtaatgatgaaagtgtaaatagcctgttcaccggtacgttccgcctgctggataacgcttgtattctcttcggtgagcaaaggtacgggaccgaatgtttctaccagataatagtaagccatcgcccggaaaaagcgggcttgtgcggtcagcgaagtataatcgcttcctgcaatatccggtgtgcagcgattcagcaggatgttactttcctgcacaatcttatagagtactttccaataatcgccaacaatcggagcggtggagttgaaagtcttgtcatagccgttgaacatacgttcggcaggttcttcggagatagccatgtagatatcagttccgtaatactgcaattcgcctgtattgaaaacattgcggtaacgggcattgatatctgtcaacaatttctgttgtccttctttagtattatagaaatcgtccgttactgccgaagggttataactatccagaaaatcggagcatccgcttagcaaacagattgctaacagtgccaaatatttaatttgttcttttactcgtttcataaggtttcaagtatttagaaggttaaattcactccaaaagtaaatgtcatcggataaagtgacaaagacttgtatacgtcttcaccaatcgtttcgggatccggaccgagatagtcggtgaaagtaaacggattctgcacattgatgtaagcacgtgcatttttcattttcatcttcttcatccagttttccggaagagtatatcccaacgtgatattctgtattttcagaaacgaaccggaaatcttacctaatacctgagtatggtaggattgcgcaccgatctgctggtactcattgctgtggttttccggagtccagtacttcacattcagtttgttccagtgttcattatcccatgcggtaaacatataagtgaaatcatcattgtaggtgccaccgatacgtgcatacatatagaaagacaaatcccagttcttgtaagtaaaggtattggtcatacccgctgtccagtcgggtgacggagagccgagtactttatagtcacgttcatcaatcacatagttctcgtccagatcagctacacggatatgtcccggcacttgtccgtatttagcagccagttccttatcttccgtctgccagattcctaccttttccagatcatagatcaccttcatcggctgaccgatgaaccagcggttagccaagtcatcctttttatcaccgtagaggtctacaatcttattacggttcagagagaaagtcagatttgtcttccacgtaaaatctttctttgagacgttcaccgtgttcagacctatttccacccctttattggaggacgttcctatattctcaaggatagagccataaccgttgaggttacctaccgaacgggcgaaaatcaaatctttcgtagtacggttatacacatcaatcgtaccgttgatacggttattcagaaagccgaaatcaataccgtagttccactccgaggtcatctcccaacgaagatctttgttacctttgcggtcacctaatccgaaagcattttcacctttacctccatagatataatgagtcaggtccagctttgtccaggtaatatcatggtcaatactgttgtttcccgatttaccccagctgacgcggagtttcagactattcagccagtctacgtttttcaggaaattctcattcttcatctgccagccgacagctgccgacggcataaatccccactgattgccggtagccagacgggaagttccgtcatatcgccctgttacagtaaacaagtaccgatccatcaacgtatagttgacacgtcccatgaaagaaagcatggatgactcccaatagtaactcttcacgtcacgaatttcttcggctgtttcgatcgcatgccagtccgagttgtaaggcagaccatcgccacgcatttccgaacccttatgagtttctttctgtacgctatacaaaccgatagcattcagacggtgaatattcttccaggttttatcataagtaatgatattgtcccatacccaattcatattccgtccttctttccggtaagcttccggtgcattgagacctcctttggcttgtgtcatcgtacctacccattctccgtaaacgtccgaatcatactgaaccgcaatctgcgatttaaagctcagtcctttgatcggctgatattccagataaccggagaagttggtatagtttgcttctttctctcttttattattttcaatctgaacaaatggattgatcttgctggaagtcggctgacaattaaacaagtagcttccgtccttatcatacgggctgaccgtaggaggcaggaagtatgcattaatcaaagcatcattggctccttcattcgtgttattcaaagaaacataactgttgattcctgttttgaacttatcagagaagcgatattccaacccaacattagccgtaatacgttcaaagctttcatcgcctaccataccgtcgtctttcaagtatcccaagccgaatgagaaagagagtttgtctgtacccccggtagcggaaacagaatgactggtagtcaatgcattctgcgacagttcacgcaaccagtcatagtattcaccatgtttgatacggcgtttttcatcatcagtcaggaagtccggacggctcagtgaagcatcaccatacttctttttccacaaagcggtgcgatagtctacatattccagtccattgcccatgttaccaatcatttcaggaatacgggtaggagtcttgaaaccaacgtaacccgaatagtcgatattaaagccctgacgcttgttagctcctttggtagtgataatcaccaccccgtttgcaccccgcgaaccgtagattgcactggaagacgcatctttcaaaatgtcgatagattcaatatcggcagagttcaaatgacgcattcccgtttgagaaggtactccgtcgatcacgtataaaggttcattcgagaaattgaacgagttgataccccgaatctctattttcgtatccgaaccgggacggttggaagtcttattcacgagtacaccaccgacacgtccgttcagtgtttcagtgacatcggtagtcaccagtttacttaattccttgctggtaacggattggatagaacctgtcaaatctttcttttctaccgtaccataaccgataacgactacttcattcaactgcttggaatcatctttcaactgaatggtaaggttcgactgattctgatttacagtcagttcctgtgtcacgtatcctataaaagaaacagcaatcgtttttcctttcggaacctgaagactaaaattaccatccaagtcagtcaccgtaccggtagacattcctaccacctgaacgctggctccgggcaacggttcttttaaagcgtctactaccacacctttcactgtaagcacctgctgtgcctgcacacttacccatccgcacatcagaagcagcaggcagaggaaagcctttatttttatcgtattatttttcatactcttcgtctgtttattaaggttagttctcaactttaaaccatttgtagttacctacaattttcgcaacgtgttttcctgtcttatccggaatgttggtaacgtcttcgaccactgtcgtgaagtcccacgcacataccagtccgctttctgttcccgtcacatccgagttcatcagcgtttttacctcattcgccgatttcgcagtactccacatgcggaatttcttaataaatccggtcatacagcgtgaattgtcagtcggttcctggaatgcccacatattctggttacgggtgttaggcatataattctgtaatactccggcatcattcttcacatcatttgtcttactgaagaataattcaccattgacatacattttcagctgtccttcaggcaaggtgttatcccacaccgtcacgacatgattccatttaccaaaattatcaggataagcacggccttcttccagtacgcggccttcctgcggtcccataccgatcgttgtacgaagattagagcctaagaagttgatcatccatccctcattcggctgcttaccgtcaaaagtagagaggaaactgccaattcccgactcaaagaaaccggcatcatacttcacccaactttctacggtgaaagtattaccgccaccataagcaggatcggaaccaaattcaatacgccctttaccgtcaatgccgaatacctttaattcggcaggcgtacccggttgcaatgtctgttgataggaatcctgaaattcggcaatcgctttttcggcggctatacagtagttatctatttcatactgtagaacaaagtagccagccatacctttagaaatacctgtttgcagttcttcgacagctttttgcaggttctgggcatttgccaatgggaaagtaccgtcacttgtaccgatctttgcggtatcaagcatgtttgtcatgtcggtcagatgcgtgtacatgcattcaagtgcaataggccgcactgaatcgccgttatcgctcttgcacgagctgacacaccaaaccaacaaactgaataaacaaagtttcataaagaatcttgttttcatacgtattaggtttttaaataaaacaataagtaaataacatcgctgcaaacataatgtagcaaggttaaacaacttattagtgatgggttaataacggattaataagcgaataaatatcattaaccgatatgtttttatcgatgaaaaggaggatttttgctcatcagctctgcataagaagtagaatattcttcattcatcatttgcttgtactcacgcacaaacagggaatattgcagaattgcttcttgtgacgaacctgtatggttaagggcatgcataccataggccagtgccagctcattaaccggatcaacccggaaaagcacattacagaaacgaatgacggcatcatacttatgctgctgatacagacgttcgatttccagtggcagaaaggaagacaagaactcttctactttttgtttgaagtggtccatcatccccgcatccataccatcaaggaatttgccacgcattaataaaatgccgagttcattctccacctcttcagcattcttcaaggtgcggaaacggaaataatcacaataacagtcagtaaacaccagtctgaaatatcccttgtcgtgtacaagttccactccatccagctcagccagatttttgcgaatctgattgatcgttacccctttcaggtttttcaccttgtcgtcgggtttatcggcccagaaaacctcattcaaggaggcagataatactccattatgggtactatgaagcaagatatagatgaaaacctgccgtaaacgggaactgaacaaatgagtaatatcccgcccattccggtcaattaccgtaaaaggaccgaataaataaactgcattcggacgaacgatggatgattcaaaatcttcttttgcaggcatttcttttcccagtacacttttatccggttctcttccgacaggtggtgacatgagcacagaagatgattccggaaccgcatttctttgttttcccctctttctcctgacaaacagcacacctccgacaagcaataatactcctattcctgccattatccataaccaacgaatctccagagaagacctggagccgtaagaacggatttcatccagagaaaccggaggggcggacaacacataagtccgaatcaccgtatgccccttcttgtcaaattctgtggtcgtacagtaatactcatgcgtcaatgaattatagtaaaggttagcattcgtcataatctcttccgaacgcatcggaatggaatctcccaaagctttcatcgttccatcatcaaccgtcaagcgataaagttgcagataggtatccgaaagatattccggataacacagggcatagatatacttctcatcaggtgtcagtatcatatcacgggcgacgaccaaacgatgatccgaagcgttctgccacaaacgtcgcacagactgctgctttctgtcaagcagataaagatcgtgaagataatttcggcctacactctgctcacccgattcgtttcccatcccgccaaagacatagatatgctcccggttcttattgactgccatacccgagaaataacgggggataatccggtcgccggaataagagagggtgtcccaacggtcggcctcgatatcatattcgaggaatgtattgttaaaacgcttattaccaaaaccgccaaaaacgagatactttccggttgtttcatcccaaaagccgtcatgatggtgcaactgtaccggcaaggctgctactccggtctgtttccactcctgattattcagatcgagcgccgctaccgtagcatcccccaacggcaggttattcaattcataaacataaagtttaccatccgttgtattcatgaaatgagtagccaactgcaattttacgggtagtttgttgctataagaatacttttgtggctgacgtttcaacagattataagtaagaagtgaatcctggctgaaaataatcagtcgctgactgtccggctcaaaagtgattcccgaaggagtctgaaaagaatactcaaaaagtttctcccaatgataagaaccgttgatgagccacaccggattgacaaccgtacccaaaaccttccctgtagaagtatgcacttcttccccttcattttcattcagagggaaagtatatgaatgacttctatcaccttccagcttcagattgcggatggcaaaagtgggcatatccaaaatataatcataacgtccgaagaagaggtgcggacaaaaagtatctttcaatcctaaagaagtaatcttcttttcgttatctccgatacgaatcgtaagtacgtcctgttgcaaatcgaatgcaaaagacacaggaatccattgataagccagtgcatcattgcgcagatttaaagaataatgattctcttttccgtcggtattaaacttgaatgtactgttctcaccatccagataagtatacgtaaagctatatttagttttcccctgatcttccttcagcagaaaaacatatccaaaagtatcaaaatcgcgaatagaaagttcaaagctcaactgaaagtttttcgtaaaacaaggtatctccccttcctgaaatatctgaagagaagtcctttctttaatttctttatcattagcctgaaacaacaatccttgcgaataagcaaacagagtcattccagtcagtaggaataagaggcaaagcctacgtcgtatcatagtctttcgatttattatcacaaatatacaggattattttaaataaccgcctaagcagatgaaaatcacctttgtcggtaccctacagttccggctgtttctttctttaatccgcacctttttctatcacccagccatttccttccgcccatatacttacctgatatcttctcctgttaccgtgtataaataagacagtcaaccacttcttatgcttcatcgtctaatatatatttaagttagcaacgtgcaaaagtaagaaaagaaatagataccatccatgatagaatgcaaattaataagtaactttgcagaaaattgaatcagtacagactatgtggatacttattataagtttggtgttgctaggtatcatcgcattgatagccggttatatccgcaacaaaagactgcaacagaaaatagaaaaaggtgaactggaccgtatgccggaagtgaaagaagcagatatagaatgctgcggacaacacgaagtgtgcgagaaagatagtttgcttgccgccgtaagcaaaaaaattgaatattacgatgacgaagaactggatcagttcatcggaaaggaagcaaatgcgtatactgacgaagaaacaaaccaattcagggatgtgttatataccatgcaggacattgatgtcgcaggctgggtacgtagtttgcaactacggggtatcgagttgccggatgacctcaaagatgaagtctttctgattatcggagagagaaggaatggggagaggtaataggtattaagtaataagtattaggagggcgttgaagttgtttttattgatggacggcattattcttgctttgatttttaattttcaatctttaatctttaattaaaaagtggatctacttcgatatacattcttccaacacgctttgctgggcagcttactggcaagcattgcctgcgggattatcggtacttacattgttacccgccgtctggtatttatcagtggaggaatcacgcacgcctctttcggagggataggactgggactgtttgcgggaatttctcccatactctcagccgccgtcttctctgtattgtccgcattcggtgtcgagtggctgagccggcggaaagatatgcgtgaagattctgcgattgccgtattctggacgctgggaatggctttgggaatcatgttcagtttcctgtcaccgggatttgctccggacttgtcagcttatcttttcggtaatatcctgaccatcaatcaggcggacttgtggatgctgggcatattggctctgatattaaccggattcttttatctgtttatccgtcctatcgtatatattgcattcgaccgcgagtttgcccgttcgcaaaagattccggtagagatattcgaatatgtgctgatgatgtttattgcgttgaccatcgtcgcttgtctgcgtatggtaggcatcgttctcgcaatatcgctactcaccattccgcaaatgacagccaacctctttacctacagtttcaagaaaatcatctggctgtccatcggtatcggttttctgggatgtctgggcggtctgtttatttcttaccactggaaagtcccttcgggcgcttcgattatattcttctctatcctgatttatgccgtttgcaagatcggaaagagttgttgcaagaaacagtcataataatagaatagtatatggaaatcaagattcaatcactggaaagtatccatgaggcagcccgggaatttatcgctgctatgggtgataacaccgttttcgctttatatggtaaaatgggagccggcaaaacgaccttcgtcaaagctctttgcgaagaattaggtgtatcagacgttatcagttctcctactttcgctatcgtcaacgaatatcgttcggacgaaaccggagaattgatttatcacttcgacttttaccgcatcaaaaagctaagtgaagtatatgacatgggatacgaagattatttctacagcggcgccctttgctttatcgaatggccggaactggtagaagaattactaccgggagatgccgtaaaagtgacgattgaagaactggaagacggaagcagagtgatcagactatgaccggacaatacatcgtacaaggaatttttgcgctagcgggaatcacttccctgctagcttccttactgaactggaactggttcttcaccacacgcaatgcccagacaatcgtccggaatgtaggccgcggcagagcacggctcttttacggcatactgggagtcattataataggaatggctgtattcttctttatagaaacacggaaggcaattctataataagctattttcaaagaaatgcgcttgttatcttcccgttttttactatttttgtagagaaaggagtatgtaattatgaaaacaacgaatgaataccttacaaaaatccgccaattcaagcaacagtgtgccgagaaatatgggattatttctatcggtatctttggttctgtggcccgtggtgaacaacacgaaggaagtgatttagatgttttcgtagaattgaaagaacccgatcctttcgtgatgttcgatattaaagaagaactggagcatatctgcaattgcaaaatagatctcctccgtttacgcaaaaaccttcgttcactcatatcccaaagaatagaaaaagatggaatctacgcttaaagaggaaattctagataagtttcttcaattatcagaatcaatctctatcattgaagacagatgcaagaatatacagaatgtagacgatttcttgttatccccttggggaatgactgttttggatgcctgcattatgcgaatacaggtaatcggagaaacaattaaggctattgatgataaaacccaaagatcatttttcaaagattatccacaagttccatgggcaaaagttattggactcagaaatattatttcccatgaatatgccaacattgactatgagattatatgggtagtcataacaaagcaccttcctcctttaaaagaaacagtagaaaatattattaaagacttatcatagcagttgccgtgatttcatctccagatatttattgatcacgtcaatagacagattttcgggtgtcgtcagcagagagtaaatgccatgctgctttaatgtagaaacgatcagtcgcttctcaaaagcaaacttttcggcaatcacgtgccggtaataatcttccgtatccctcgccggactttcgatgtacgctttcaagtcagcatcctcaaagaaaaccaccagcaaacgatgttgccggttgagctgctgcaagtaagccaactggcgattcatgctgctgatactggcaaagttggtatacagaaccaaaaagctacgcttattgacgtgcttgttcagatgcacacaaagagccgagaagtccgtttcaccaaaagtagtctgctggctatacagcttttcaagcagcgtctgcatatgcccgggctgcttggaagccggaacgaaggtatcaaaatgctcatcaaaagtcaccagccccgctttatcctccttccgcatcgccacatacgaaagcaccagcgaagcattaatcgcataatcgagcaaagtcattccccgaaaagcctgctgcatcaccctgcctttatctatcacactgtaaatctgctgagagcgttcgtcctgatagacatttaccatcaactcatgccggcgggcactcgctttccagttgatagtccggtagtcgtctccttttacatattccttgatctgctcaaattccgtttgatggcctacccggcggatacgcttgatacccagttcggtaagattatcactcattgccagcaattcgtatcggtgaagcatcagataggaaggatataccttgatatcctgcgcctgcccacaagtgtaccgacgggaaagcagcccgattttatcggtcacaaatacacggatttgcccgaaagagtatactccgcgacgggtcggacgaagatggtaactgattgttttcccctcgttcggctgaagggtagtccggaaacagacatcccgattctggaagataaaaggtatttcatctatgatctccagagagagaggacgcgaataagtactttcgacacgaatgctcacttcattgtcatcgccattggagaaacggtcggaacatcgacggaatgcctgaatcccctgggtacggtagagaatatatccatctgccgataccaacacgaataaggcaaaaagcgcccactgcccgatgacaaaaaacggagcaaacagatatccgctacccaataagaggataaccagaataagggcaatatagaaacgacgggttaagtacaatttcgggttctgagttttgagttttaagttttgagttacgaattatagagattcggttcttatttggggacctccactttatcaatcaggcgttgcgtaacctttaccggagagtatccttccatttccgcttccgccgtcaggatcagacgatgctgaagcacatacggagcaacgaacttaatatcttccggtgtcacgaagtcacgtccctgcaaaagggcatacgccttggaggcttgcaacattgcaactgatgcacgcggagaagcgccaagatatacagctttgctggtacgcgtctgctgcacaatcaatgcaatgtattggagcagcgtacggtctacaaacacctgattcatgaaggcacgcagtgacaggagttcttctttggtgatagcgggcttgatatcgtccagcttgattaatgaagcgttcgtatggtgacgttccaaaatatccacttcttcttccagcgaaggatagtccatcgttattttcatcagaaagcggtcgagctgtgcttcgggaagtttataagttccttcctgttccacggggttttgtgtggcaaggatagtgtagagttcacccatcttatgagtaatgccgtcaatgcttatctgacgctcttccatcacctcgaacaaggcagcctgcgttttggcaggagcacggttgatctcgtccaccaatacgatatcggcaaagatcggtccctgatgaaagtcaaaatcattggttttcatattgaacacagtggtacccaagacatcgctcggcatcaggtccggcgtaaactggatacggctgaagtccgcatcgatcagacgagccgtcaatcgggcaagcaatgtctttgcaactcccggcacgccttctattagtacgtgaccattggcaaggatggctgccagcaccaagtccaccgtctgttcctgaccgacaataacggaagcaatctgatccttcaattcctgtatcttctcggaaaagagagttaaatccactcgttgttctgtattctcttccataaatatcttctttaaatatgattgattatttcattcattttatcaataaatcccttcatttcttcgccggaaaggacacgtcctccataaatcaccggtctgatttcgcggatcaacctgctgatttcttccacctccattcccgtcttctgagcgatccggtggaaagaacgttcatcgtccgccacttcctccacatctacctgaatttctcttctcagcacttccgcaaagtaggtgaacttcttatgaaccagattggcatggtcattcttctgataataaagcgtgcctatcaacttggtaaattcaagggatttgttttccggttcctgtatgacaggtattgcccgttgccgcctccgtgctgtaaacaccataaagagcaagatagcgaacatcgacagatagatcgcccagcgaagcggcctttgcgacagaaaataacgcaaaggagatcgctgcgtctgtgcagtctccttcatatatccttcggtgcggacaataggcaactctcccatctgcgacaggatgcggaatatgtaagtcgcatttttctcatccagcactccataattggtaaaaagcaaaggagtagaaaccagaatgatttcaccctttccccacggacgcaccatagccaccaacggatgataattgcgggaaacggtcgtagaatccagttcatccaatgcgtgccccatatcgcttgccagattgatctccgccagtttacgtaccggcagcgaatcataacggcggaaataggacttgcagaactgcggataaaaacggaacacctgccgtgaataaacttccggatcaccgatccaataaatactgtcccgcttcaataacgaagcggcatattttttcaaatcgaccgatctgaaataagaataagtgcaatcaaacttcagcgtatcctccaaaatcttggtaaaagaactgcttaccagcatgatcttatttccccgatccgccattttgagcaaggcttctatatccacccgtccgaaaggtaaattagtggcaatcagcagtattcctttattgtgaacagtatcttcctgttccatctgataaaaagtctttcgggacagtgtatatcccgaaggcagtgaaacagtcagcagactgtcgaacacagcgcatccgaaaggctgctcatcgtaatggctaaaggtaggcacccatacaaatttcttcggcagatgatattctatagcaaacatcagcagcagaaaagcaaggacaaagaagataaaccagcggcttcccctcatgagccccctcctttccctatttcttcctgcaaggatttcatggaattgaacagttcttccgttgcctcaaagttaccgtaacgaaccctcaggaaatgattggtcaactgacggaaaacgggtatccgtacttcattgatatactgtgtcggtgttttataaggctgccagtcaatgcgtttctcgtcgctaagccgtttcaatgtctgcaaataaagcagacgcaccgcctcccgataatcggaacgggaaagcgcatcggcaatccctcccgaaaaatccacaccgtaaatcgtatcttctcccacttcataaggcagtttattcttgggcgaacgcatgaataactccggacgcttcttataaacaaaccatataatcaggagcagaataataatggccagacatattaatataagttcagaatactcttcggcaaaacggctgccgaatatcttccgcaacaattccccaaactgcctgcgaaaccattcaaagatattgatttcaggagttatcagttcacgattgtagtcatacgccgattcggattgccatttggcaatctgcacggtgtcgcaaaccaatgtatcagccggggatgtcagcatctattctgaattatatatgtttagagtttatcgaaattatcaatatcgctctctacagttacactatctaccacttcggaagcgtgaccgtactggtaggccattccgacaaaagtgaaaatcatggaaagataagcgccgaatgcctgtacaataccaagcagataaaggataaagctatatcctgccgatactgtcgtctcgcttccgacatcacttaatgagaagaaatatttcaccagcgtagcgatataccacggcatcatagtcactccctgcaatacattagctataaatcccatgatcagagatatcaagaagacgcctccccaagtggcaaagcccagccggaatgtctttttgaaagactccatcactgtaatatcttcaaacaggtagataggtgcccataatgcaagcggcactacaaaagcgataagaagcggaatggtcagaaacaaggtgaacagtgacagaaacgccagcagacctaccacaagccccacgaaaagcatgactaagatggagaaaagggtcattacaagcagtctcttgatattgcggaacaataaaggcttcaaaatacccaacgtgattccctccaagcgttcttcacgttcattataggtacggatcaatgcatagatcatggaggtcagcaaaatactgcctatcataaatacaatcatatacagaccgtaataggacataaatcccaataaagatgcagtatccggcaccgtcgcagtcttggacatagcagtcatggcaaacgctcctcccatcagtccgttcagacttaatgcctgaataaggcttacaggcaaaagcagataagtcgtaaacttcaacagtattttccaattctcttttatgaagtcaaaagaagcgttcaacttatcaccgaaagaacgtttcacgtacattgcaaccttaggtttctgtgattccatgtttttttctatttggtaaataaatatagtaaaagatgataaatgcaagggatgtaaggatgatgccgagcctcagcatatccggaagttcggtgtgacgggtgataaagccttcgataaatcccgccatgataaacacgggcaccgtaccgattacaatcttcagccctcttttcgctcctctgcgaaaagattcgagtctcgaataggtgccgggaaacaaccagctgttgcccaaagcaagtccggcagcaccggctacgatgatcgcccatatttcaagagttccgtgcagccagacggcaagtgccgactcccaaagcaggtcgtgctgataaaagaacatctgaaatgaaccgagcataattccattctgaagaagtataagccccgtaccaaaactggtcagtatccccgcggcaaaacacaggaaggatacttttatattattgattgtaatgcccagaaacatcggagcttcgggagagccattgtatactgccatcggctcacctctggcaatattgtccaatgtcatatctacgtattggttgcccattatcaaacgcacaaactcctgatcattggcggcagatactgccccgatcaacgcactgacggcaaagatgataaaagagatcagtaactcacgctgcgcatcatgcatggtctgcggcacttcccgtgtccagaaagtgataatgcgtgtccatttctcacgcttgctccgatagatttcattatgcagggctgaagcgagattattcaaataaatggtaatgcgggaagtcgggaaatgggtctgtgcaaaagcaaggtcggcagtcagttccgtataggcgtcggcaagttggtcaggggacaggtttgcagcctgttccaccaccttttcggtccctttccatttttcaatgttccgacggataaacgtaacttccttcatgcttttcagagatttcggataagttttgtccgaaaccgaaagcaaaagtaaaagaattatgatatatttgcaacttaaacctaaaaatatttaaccaagaatggcagaatctacgattattatttaaatattcaataaaaagagcaacaaagactataaatcagcctttgctgctcaaaacagacctaagccccagtttatttatttataatattgtaaatcatagaaaagttcctatcataacttccattagatgtatcaaaggtaatagaaaggtctttatttactaaataaaagccatcgtaatatcctccccaacccatattcgcatggaaatagaaatcaaagtttttaactaaatatcttgtttggggtctccagtatgcaaaaccatctaaaataaaagcatggcttcccccacgattagaggttgcagctatccataccaacttagctagttgtaaagattgaaatgcagcattaccatcccaaccatttttaagaccactagttgaaaaaaaacgatagaaaaagctagatgtatcagaagaataagtaccagacccagtaacataaccacttgaatttctaacaggctgtgtattagttgctatatagatatattttatcaatttagcaaccatttctctagttgtttcagaggaaggagtttgccaagatgaaggagcaataatttgtttttgcgctttcaagatattccaatcaattttcagaccatcaaccgttaagtcaggttctaaagaagccataatctgtgctattgaaataacagcacaaccagcagggacagcctcgtaagtaggtgagcctgtatcataaagatcacaattttctttctgtagcaaatcattatatggtgcgtcttgattccactctgtactactacagtacagaccagcaaaacctatcggatttccaataggaaatgttggttcagaacgggatagaatctcatcctttactataattatatcttgaatctcatcatacctcacagccttcacgtttaaagtttttgctattttcgctaatgttttagctctcagttctgattttaccttttcataatatttggcatcttccaacagactcaattctgataaatagagcatagacttagaatctacatatttaacagagtcttttaaatctgttttaggcaaataagccattatctttgcaaaacgttcatcagcaggaacataagccacacctttcccctcatcacttaaaaattcaattttataaacaggaatagtagtaagattagttgaaccgactcttgtttttaatccagaagaactagatacattatatgtagaaatagccataatttttacattattatttctagtctgtaatcctgttggattaaagtccaaaacaagttgcttagcctcttctgaagtaattattccaggattatcataagcaatgctaatatactcatctgaagataataaaattttagaatcattcagattatcttgcatacctagttcattactacattttatccctttacattttaatcaattgtgaaggaattttttatattggtgtatattaatataattttaagagttatgatttacggatacattagagtaagcagtgacaaacaaactgtagaaaaccaacgttttgagataagtaatttctgtaataataatgagttgacaattggcgattggattgaagaaactattagtggaacgaaaaattacacaaaacgacagcttggacgtttactgcgtaaagtacgcaaagatgatattatcatctgtagtgagctttcacgtcttggacgcaatctttttatgattatggaaatcttgaatatctgtatgacaaaagaatgtaaggtatggacaattaaagataactatagacttggggaagatatacaaagtaaagtccttgcctttgctttcggattgtcagctgagattgaacgcaatcttatcagtcaacgtacaaaagaggcgttagcgagaaaaaaagcagaaggggcaatgctcggacattgtcgtggctttcgttgtagacttaatcccaaatgtgccaacaagcacgattatattgtaaaagaattggctaaaggaacagaaaaaacagttatatctaaaagattgaaagtatcaaaaactacattatatcgttatctcgtttatacggggcttcatttgcctataaactgtcaacaagaaggatgggaagagtatggtatctatcattgatttctatgtactacagaagcgaccctcaaaagagggcttcgatattgtcattggcaatccaccgtacggagcgaaatacgacaaccaaacaaagaggtattataagaatacctatgtgacggcaaatagcatccgaggattacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggctcttgatacatatacactattcatagaattgggatacaatctgcttaggaagaatgggagttttgcctatatcgttccaatatccttgacatcaagtgattccctaacaggcgtacaccgtcttttgatgggaaactgtgataccatatacatatcatcctatgcagtacgtcctaagcctgtttttgagaacgctgtagtaaacacttcgatacttctttttaagaagactgaaacgccatgtcagtatattttctcaaccaagatgcacagaagagggaatgagtttgaattacaaaggctcattgataatttgcaatttgttgatgtgaaagggcaaacactttatggtcgtattccaaagataggttctgaaatagagaaaaccatcttaaacaaactcttcaactatacaaagttaggatctcttatcaagacttcagggagtccaatcatatataggtttgcaggagggcgatatttcaaagtcgtaacaaattatagtaccggttcatcagcagagagaactatctatttcgctaattccaaaatcgcagatgctgttggctgcatactcagtagcagtttgtcattttggttctatcagattttttctgataatttaaattggaagacatacgagatagagaatttcacagttccacagctctcagctgaggatattgactatcttgacaagttgtattctcgttatctttctgacatagaggcaaaagctaatatcagaataacttctggagagtccacctataatgttgattcattcaaggaatacaaaattgtacgctccaaagccatcattgatgagatagatgactacatctgtccgctatacggattgacgcaggaggaaaccgattttatcaaaaattacgaattagaatttaggttggctggagaatgaatgataattggaggataatccctccaattatcataatctttcctttcagaattaacgcttattcagcatttcgatattgatagtcataattgattaaaaattttatttcaatctcagataaaccatatttttctccaataaatttatcaattgcatcaatatgcattttagattgtcttgcaaaaaaacatttcagtcccgttttagttgtctggctctttgaatataaatcattaagataagtatcatatattgacacattccggatagctcataattcattttaaatgtctacctttgcacgctcaaataataatatagtaactggtaaaatagtaaataatagaaaatgattacagtttcaaacgtttcggtgcagtttggtaaaagagtcttgtttaatgacgtgaacctgaaatttacaagtggcaactgctatggtattatcggtgcgaacggtgcgggaaaatccaccttccttcgtacaatctacggagatctggacccgacgaccggtacgattgccctgggaccgggcgaacgcctgtcggtgttgagccaggaccactttaaatgggatgcttatacggtaatggacaccgtaatgatgggccacaccgtgttgtgggacattatgaagcagcgtgaagtattgtacgccaaggaagacttcacggacgaagacggactgaaagtatccgaactggaagagaaatttgccgagctggacggatggaatgctgagagtgacgcagccatgctgttgagcggtctgggcatcaaggaagacaagcattatacattgatgggtgagctgagcggtaaggaaaaggtgcgtgtgatgcttgcgcaagcattgtacggcaaccccgacaacctccttctggacgaacctaccaatgacctcgatatggaaacagtgacctggctggaagaatacctttccaacttcgagcacaccgtgctggtggtaagccacgaccgtcacttcctcgactccgtatgtacgcacaccgtagacatcgactacggaaagatcaatatgtttgccggaaactacagtttctggtacgaatctagtcagctggcgctccgtcagcagcagaaccagaaggcgaaggctgaggagaagaagaaagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttcactcccgaacgcgagccgggcaaccagatcctcgaagtttccggactgagcaagaagacggaagaaggcgtagtgctgttcagcgacgtgaacttcaacatcgaaaagggcgacaaagtggtattcctttcacgtaacccgcgtgcgatgaccgctttcttcgaaatcatcaacggaaacatgaagccggatgccggacagttcaactggggagtaaccatcacaacggcttacctgcctctggacaatacggacttcttcaacactgaccttaacctggtggactggctgagccagttcggcgaaggtaacgaagtgtacatgaagggcttcctcggacgtatgctgttctccggcgaagaggtactgaagaaagtcagcgtactttccggaggtgaaaagatgcgttgtatgattgcacgtatgcagctccgcaatgcgaactgtctgattctggatactccgaccaatcacttggacctggaatctattcaggctttcaacaacaacctgaagacatacaaaggaaatatcctcttctcttcgcatgaccacgaatttattcagacggttgccaaccgcattatcgaactgactccgaacggtatcatcgacaagatgatggaatatgacgaatatatcacttcggaccatatcaaggagttgagggcgaagatgtacggtgataaatagcgtgttgtatcagccggatacactgaataatgtatagaaggtagtataaatagtaccttactgttaaataaagggaaatgcttgttgactgtcgtcacattgcttttccctttccttttgtatattgaagtatataaacttgtattgtactgtttgtaaaataaagtttatttagatgtgttgctgagggagagatcgaaagttccaaaattcctccagcaaagtccagtaaagttcaaaagtccactataggattttcagaaaacggaaattggattaaaaacgaggaagaaatgagcagagaaggacttggcgggcatatttaaattttcccggactaaacctgcaatctgattcccaccatcttcaaaatgtgtctccatcataagaaaataacgtgaataggatgaatagttgttgttatttattgttacgtgtgttgccggacgaaccggaagatgttgaacagtcttcttatttattcttgacaatatcagtcgcacgtatatcgaagtagcgttcgccattttactatattacgttgaacataataaaatggtcaacacctgcgtgagaagctttgtcgaagacacgaaaacgtgcaatcgtctgacatatctcgcatctttcggagaagcttagacagtttttggggctaaagattcatgtgttgcgggagaggaattaaacttctctagaagcgctgtttattatttaataaattaaggtgttaatgcttgaaatatagtaagttatatcgcagattgtgtattctaaaaatctaatatggactttctggagcctataggcggacgaaacgttgcctatagccggacgaattaattcatgcactcgaagatattattttttatagagaaaatgtttattgtattctactgtaatgattgaagaaattgggaagtggatttaataagtagaaaaatgtccatgaaaactgatatgatgcgtggcattgagaaaggattttccttgctaacgcttttttgcagcttaattcccttgcttttcgatattcttttttatatttgcctacaataaacaaggagatacgacgattgaaatataagatattgataggatgtatgttgtgcttgttctcttttattccgaagggggcagccaatcttgttcttaatccttatacaagtcaggagatatctgctgattccatcattgagcgtgtcatgacttttgctccctcttatgaaagtatagtgagcgactatcgcgcgaacctatatataaagggtaagatgaatattcagaagaagaattttatcctccggtacgttccttcgatgtttcgcttgcagaagggggtacgtgaatacttgctcgaaacgtatagtgacctgcattatacagctcccaatatctatgaccagaaagttaaggcatcacaaggcactgtgagaggaaacaggggactgccgggattacttgaatattttagtgtcaatatctactcatcttctcttctgaatgacgaacgcttgctgtctccgcttgccaagaacgggcagaaatactacaaataccggatagacagtgtgatgggcgatcccaataatctcgactaccggatacgtttcattccccgtaccaagagcgaccagctggtgggcggctatatgattgtcagcagcaatgtatggagcgtgcgtgaaatccgtttttcggggcggtcggaactgattacgtttacttgctggatcaagatgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaggttcggaagaaagagaagaaaaagtataatctgtcggaatcattctccttgcagtgcgatacgaatgcctataaaacagatgcgtccacgttcggcgtgctacgccccatccctttgagtgaaggagaaaagcaactttacaaagattatacatacaggcgggataccgtgtcggtgcaacagaaaaccaagagtcaggctttctggggaacgatgggcgacctgatggtggaagattataaattcaacctgtccaatatcggaagtgtccgcttctcgccgtttatcaatccgcttttgttcagttatagcggaagcaacggattgtcgtaccggcaggacttccgttacaatcggattttcagaggtgacaagtggctccgcatcgtgcccaaactgggttataactttacacggaaagagttctactggtcgttgaatgccgactttgagtactggccgcaaaaacggggctttttccggctgagtgtgggtaatggtaaccgcatctatagcagcaagatgctggacgaactgaaagcgatgccggacagtatctttaatttcgacctcatccatctggattatttcaaggacttgtatttcaacttccggcatagttttgaaattaccaacggactggatatcagcctcggtttctcggcacacaagagaacagccgtcgagaaatcccgttttgtgattacgggtgactatccgatgcctccgccggaatttatggaacgcttcagaaatacctatatcagctttgccccgcgcatccgggtggaatggactccggcgctttattattatatgaacggaaagcgtaagatcaatctccgttctgactatccgacattttcggtggactatgaacgggggatagaaggagtattcaaaagtaccggagaatatgaacggatagaattcgatcttcaacataagattcagctgggactgatgcgaaatatttattatcgtttcggcttcggggcatttaccaatcaggatgaactgtactttgtggactttgccaattttgcccgtcataatctgccggtagggtggaatgatgaaatcggcggtgtgtttcaagtgctcgacggacgttggtataactcctcccgccgctatgtacgcggacatttcacttatgaggcccctttcctcattctccggcatttgatgaaatatacccgctatgtgcagaacgaacgtctttatatcagtgcgctctctatgccgcaccttcagccttaccttgaagtgggctacggcatcggtacgcacgtctttgatgtgggagtattcgtcagcagtgagaactggaaattcagcgggatcggatgtaaatttactttcgagttgttcaaccgatagtttttctttgtaataattgcataatgtgtataaaatacatatctttgtaaggaagaggatgaggaaaaatttagcagataagaggtgtagtcgcctcgcaggcacaggtgttttcctagaaaataaatacctaggtataaatacctaaatttattttagtaaaatctcgtcctcttcttctcctttttatatatgcaacaacaagatggacggaattttaattacgatacttattgttaccggttttctgatttataaattgatttcttcgagccggaaacaggaaggatacaagagatggaaagcaacaggcagcggtaatactactaacgaagagacttccaaaaacaaatgggaacatggagcctggctcaggcatgctctaggagtagtcactcctaaaacgagaacatgtcctgtatttgatgaagaggcggtggtgtggtgtgccaatctgttgggaatagaggtgatgaggctgaaagagatactgcaggatgtctcttctcattatcgggagttctggatcagaaagcggagagggggataccgcatgatctctgctccggacaaggaactgaaagccattcaagatactatttatcaccgtatattactgtctgtaaatgtgcatcctgccgctacgggattccggcgtcagcattccatcgtcgataacgtccgtccccatttgggaaaacgctatgtcttgaagacggacatccacgatttctttatttccatacgcagtccgagggtgaagaagactttcgaaaagatcggttatccgaagaatatatcgaaagtgctgggcgagttgtgttgtatgcgccggcatttgccgcaaggagcgtctaccagtccggtgctgagcaacatcatcgcttatgagatggaccggaaactggcggcgatggcggaagaattcgggctgacttacagtcgttatgccgacgaccttaccttttcgggcgatgtctttccgaaagatcaggtgcttgcccgggtcaaggaaatcatcagggaagagaagtttgaaccgaatcatcagaaaacccgttttctgaatgagtatgacaggaagataatcacgggcgtatccgtcagctccggtgtgaagctgaccattcctaaagcccgaaagagagagattcgcaagaatgtctatttcattctgacgaagggactggcggaacatcaacgcagaatcggttcccatgatcctgcctatctgaaacggttgataggatcgctttgttattggcgttccatagaaccggataacacgtatgtatccgattctatcgctactctgaaacgtctgcagaatggttcttgacggatggcggtggctgtttgtgcctgccgttccgtattaaccgatgatcgttgcccgtccgttttccactctggcataattctttttcaccgcttcctgaatacctctgagcatggatgcttcgatgtttgaacccatgcgggcaaaaccgaatatctgtgcgcaagcttttatcagatccggcaggggcagactgatggagtcggttaatatctgccggatggcattggctgtctcttcgggtggcaggtctgctgcatcccggtcggaatcgggacggtactccgtataagaacggtattgcgcttcatctttccagcagaagacaagaccgtcatgttctatgcggtagagatgtaatgtgtcgaagattgtctccaggtaagcatctattcgtggccctagacggctgattccccattcggacagaatcttctttccaagcaaggctttactgatcggagcttcattctccactatcttccggatttgggcgataagaatgggcttgttctcggcagcgaagatatcgtcggaggcgtagtggtatgaacttactttagtactattataattttgtacaaagataggagaggggcttgtgtatgcggactttagctgcatcggcttttcctgcaccctttcttcttctttttcttgtttttcctgtactacgaccggtttgggggctttcattccctgtacaatcgctgtctgtatggatgcaatcacttcatccggcttttcccaccagtccatcgtccatatacggcagatattccatcccagtgctttgagtacattgttttgaacaatttcccggtcgcggacagtcttggtacgtctgtagttctttccgtcacagataatgcctaattggtagttggacgggttttgagtatcgacaatgcctatatcgatcttgtatccggaacagcctatatcggtatgtacggtatatcccaaagaacgcaacttgtcggcaataatcttctcgatggaagtttcttcttccgagggctggatgctggtcgaggtattcagtatgcgcttggttcctttctccgcatattcaaggaagcgtttcagtccggctactccgatagaagaagtccggttcagatcgatcatgtccgatctcagcgtagagaagatgatcatttcgtatcgggcacgggagacggctacgttcaaccgtctttcacctcccgcacggttcaacggaccgaagttcatgctgacgcgcccttcggcatcgggaccatagccgacggagaacagtatcacatcccgttcgtctccctgcacattttcaaggttcttgatgaacaggggttcttcacattccagcgcaaaggtttccagttcggggtggaagatgaagagatcggataacaaatcttctatcaacgcctgctgaaccacgctgaaagtgactacccccacactctttttccttaattcttcgcttctcagccttctcgctatttcgtctactacggcttgcgcttccgcttggttctgacgggattttcctttgtcataataaccgtctacggcgaccattctgactttcgattcgatgttgtccggtgacgggaaagtcatcagcttattatcgtaatattcggagttgctgaaagcgataagactttcgtgtttgcttcgataatgccacagcaggtatttggaagggatagagagagcaaggcagtcgtcaaggatactttccagatcttccatctcgatgttgtcttcgtcaatggtgttgacggagaagaagctggtaggcggcatctgtttgggatcgcctacgatgactacattcttgcctcgggcgatggcgcctaccgcttcgtaagtcggcatctgtgaagcttcgtcgaagacgatcaagtcgaatttgtccgcatcggtgtcgatatattgggcaaccgatatagggctcatcagcatacaaggacacatacgcgacagcagggtaggtatctgatcgaatagcttgcggatggatattccgcgtgcattattgcgtatattcttttgtaatattccgacttctgaactttgaatggcttcgtgggtgaaggacggaatgttggaagccagtctggcgaacagttcctttttggtaatgtcctcgaagttggcggatacttgcttgtatttggctataatatcattgaatatcttgccgttgaataattccagtgtcggttctttggcgatgatatagtgaataacggcttggtagaaactcttgcagaagctgctggtgagcaggtccgtaggaatattcttttccttatattcttctgcgataaatccgatacccagttcgttcagcttgttgtaggattgaagccattgataccagtctttgagtttgtccagattttctttccatgttgcggcttgctgtagggcgatgccgatccagtcggcggagtttgtataaagcgtctctacggttatgcccagagtggtggaaagccgttgctcggttgccgtaagcgtgtcggccagctgatgcaattcattcagagaatgagaatggatatctctgaatgtccggataccttccgtcagttgtaacgctaaattctgtttgatccgggatgttttcgccacatcttttgaataactcagtaacagggaatgaagcgaagatacctcatggatgatctgatcgatgatgtcccactcttcgtctcttccgaatcttccgaataaagaaggcagcttggcggtgtatctgtctgtaaaatcaagctcttcctgataccggatgacctgatggagcagaggctggactgtctccggctctactggctgcagagcgtaaggacgaatcgccttttttatttttctttgtccgaaataccgtgggagaaaccattgggcggatacccgattccattcggccagcatggggccggcgtttatcttcagtacttctttggtgaatccgttttctatttctgctttgatttcatcgcgtttcctgccgtgcttcgtcactttccggtactcttccagcgtttcatttaataaaggagtggtcagcagttcgggcgtcagttccggaatttcgagtattttccggataatggcggtgattatatcgaaatccttgcgggtgggatgaatgtccgtatcttccagtaaagcggagaagacaggcagttttgactgtatggcagtcaataagccgatgaaagtggcgagcgtttgagaggcttcctctttgatggcggacgaatattcccgaatggaaatccctgtcaatgggtgaagatgcgggtggccgcaagcattggcggtactgaccaaagattcgatggcatcttcccaatgtgagaatcgatccttgtccagatcgtccagataagatgacgggatatcgaagcagggttcaacgtctgttgactggtagtggatgatcgcatcatagagggaaagcccgaaaggatattccttgtgtaaggcttcgatgtatttgtttagttccgttcgtaacttcagcaggcgttcggcttccttcttgaactcttcgggaggagttcgtctgatgatttcggttgtctcctttagttgcgagatgacagtggatttctttgtcttgttggagtgaatttccagacagaacggagcaagtcctatcgccgccagtctgttttggacgacggagagggctgccatcttctcggcaacaaataagactcgtttacccttataaagcgcgttggcgatgatgttcgttatcgtttgggactttccggttcccggagggccgtgcaggataaaagtcttgtcgtgcaccgcctcataaatcgcttccagctgagatgaatcggcaatgatgggcagcacgatatctgccggagataactgtctgtccatgtaagaggcatccatctcttccgtaatcgcgttccattcgatctttccgttgatgaggctggagacaatcttgttttgagtcagtttgggagcattgttgtggatgtcgttccacatgataaacttgttgaaggagaagatacctaaaatagcctgttcctccacatcccatttacgctgattcttgatgcagtgccggatgatggagtaaatcagttttacgttgactccgctttcgtccgtcggaagcggatcaagtcccggtacggaaatgccgaagttctgacgaagcatttccaataaggtgatattcatcatcgtttcttcttcccgcgaacgaatcacataccctttggcggctgacttgcggatgatttcgactggcagcagcaatatcggtgcataacggggacgttcgctggaaggtgtttcgtaccatttcagaagtccgagagccagataaagcgtgttcgctccgttctcttcgatagaagtacgggacgaacggtacaggtgagtcagtgctttgcccaaatcattctccggcaagtaaaaacgtaaccttttctgtgaaagctccgaattaacgaagtcggctatcggatccgattccggtatggaagaataaatgccaaactccatcgccggattctcccattcggcgggacggtggaggatacgaaactcatctccttccgccaaggcgtcttccagacaggcaaggtttgccggaatcagctgaagagtgttctttgtaatccggatattcagcaagttgttgcgcagactcaaatccagcagtcttctctcccaaagcaactgtttggtgaggactgtctgagtttcgctgcccgacaaatcatatggattcacgctttgcggagtggcgtgcgtggtatttctgttcatatcctcatcttcctttatttcccatacttgtccgttcagtacgcgctgcgggatcgggcggactcccgaatgcctggcccttctgacgtcgatggcgaggatgaaactgcccggatcgctcagtttgccgttcgcgcttttcacggcgttgtcgaagtcggcattatgtcccatattcatgcaggtggtttctaccagcgtgatgtcgtagattccttcggcggttcgtttggtcagtaaggatacatcgtcgatggcagggtccggaaaggtttccggcaccagccagccacctgcgaaagcatgtcctttggtgatgacgatgagggcattcagtccgatggattcgaggcaggaagcataaagcagtgccatatccagacaagttccgagcttttgtgccagtacggaatctgtcagacggacacgctgcccgtgctcttcgaagctggcgggaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggctctcttgataataggagtgagcacggcatgattgggggtgatgaacgctgccagcatctcggggaatatattgattccgccccattggtcgtatgccagaatgtcgatggggtaggtccgggtaaagatcgtttccgcctcggagcggatttctattttcagacttcccgacatacgctcggtcagctgggcgaaataattggcggacaagaccaggctgaacgattgcagacacacggaatcattggcgggaatcgcttccaccatcacaggagtgatactgccgaagtcgggttcggcagtgatttgtacctgaatgtttctgaagggttcggacgtcatgttttcaatcgaaagctgatggatgaccgatactttgttttgctgcatcgcgaaattaataagtggcagataatcaaactgcaccctgattttgtccaatgttccgtccatgttgaaagtcgtataatgttagacttgcaatattacaaaaaatacggatatcaccatcttttctttgggtattcttttgtcggtcaagaaaatattcctacctttgcgcccgatttatagataatataatgtcttattcaattaaagtattaaacaatttatttattaatggaaaacttaaagaacgtagctcctattgaagacttcaactgggatgcttatgaaaacggcgaagctgtaacaagcgcaagccacgaagatcttgaaaaagcttacgacggtacgcttaacaaagttaacgaccgtgaggttgttgacggaaccgtaatcgcaatgaacaagcgtgaagtagttgtgaacatcggttacaaatcagacggtatcattcctttgaatgagttccgttacaatccggacctgaaggtaggtgatactgtagaagtatacatcgaaaaccaggaagacaaaaaaggacaactcgttctgtcacacagaaaagcccgcgctactcgttcttgggatcgcgttaacgctgctctggaaaatgaagaaattatcaagggattcatcaagtgccgcacaaagggtggtatgatcgtagacgtattcggaatcgaagcattcttgccgggttctcagatcgacgttaaaccgatccgtgactatgatgtattcgttggcaaaacaatggaattcaaagtggttaagatcaaccaggaattcaaaaacgttgttgtatctcacaaggctcttatcgaagctgaactggaacaacagaagaaagaaattatcggcaagctcgaaaaaggacaggttcttgaaggaactgttaagaatatcacctcttacggtgtgttcatcgacttgggtggcgtagacggtttgatccacatcacagacctttcttggggccgcgttagcgatccgaaagaagtggttgaactggatcagaagctcaacgttgttatccttgacttcgatgacgaaaagaaacgtatcgctcttggcttgaagcaactgactccgcacccatgggatgctcttgacactgacttgaaggtaggtgacaaggtgaaaggtaaagttgtcgttatggctgactacggtgcattcatcgaaatcgctacaggcgtagaaggtctgatccacgtatcagaaatgtcttggagccagcacttgcgttctgctcaggacttcatgaaggtgggcgacgaagtagaagctgtagttctgactttggaccgcgaagaacgtaagatgtctttgggtatcaaacaactgaaacaagatccatgggaaactatcgaagagaagtatcctgtaggttccaagcatactgcaaaagtacgtaacttcactaacttcggtgtattcgtagaaatcgaagaaggtgttgacggcttgatccacatctctgacctttcttggactaagaaagtgaaacacccgtcagaatttactcagattggtgctgacatcgaagttcaggtattggaaatcgacaaagaaaaccgtcgtttgagccttggtcacaaacaactcgaagaaaatccttgggatgtattcgaaactgtattcactgtaggttctgtacacgaaggtactatcatcgaaatgttggataagggtgctgttgtagctcttccttacggtgtagaaggtttcgcaactccgaaacaccttgtaaaagaagacggttcacaagctcagttggatgagaaacttgaattcaaagtgatcgagttcaacaaagacgctaagagaatcattctgtctcacagccgtatcttcgaagatgtagctaaggctgaagaaagagcagaaaagaaagctgcttccggtgctaagaagtcttctaacaacaagagagaagatgctccgatgatccagaaccaagctgcttcaactacgctgggcgacatcgacgctttggctgctttgaaagaacagttggaaggaaagaaataatcgttatttctatataatggaaaagcgctccggttgtcggggcgctttttttgttttgccatgatagcacaaataccaaaaaacttgtgtacatttgtgccgctatggagaaattcgaactacatatacttggatgcggttctgctttgcccaccactcgccattttgcgacatcgcaggttgtgaacttgcgtgaaaagctttttatgattgactgtggggaaggagcgcagatgcagttgcgtcgttcccgcttgaagttttcccgcttgaatcatatctttatttcccatcttcatggcgatcattgctttggactgttagggctgatttctaccttcggtctgttgggacgaacggcagacttgcatatccattcacccaaaggactggaagaattgtttgctcccctactttctttcttttgcaaaacgctggcctataaagtcttcttccatgaatttgagacgaaagagccgacgctgatctatgacgaccgctcggtggctgtgaccaccattcctctgagacaccgtattccttgctgcggttttctttttgaagaaaaacagcgtcccaatcatatcatcagagatatggtggatttctataaagtacccgtctacgaactgaaccggatcaagaacggagcggattttgtaactcccgaaggagaagtcattccgaatcatcgtctgacccgtccttctgcccctgcacgaaaatatgcttattgctccgatacgatttaccgacctgagatcgtggagcagataaaggggatagacctccttttccacgaagccacctttgctcagaccgaacaggtgcgggcaaaagaaactcatcatacaactgctgcacaggccgcacagattgctttgaatgctgaagtgaaacaattagtcatcggacatttttccgcccgctatgaggacgagtctgtattgttgaatgaagcggcggctatcttcccccaaacggttttggcaagagagaatatgtgcataaccataaataactatacagatacgagagactatgaccccttataacgaacgtgaagttctgaaactccttcaggaggagagtacacagcggaaaggatttgagttgattgtggcgcaatacagcgagcagttatactggcagatccgccggatggtactgtcgcatgaagatgcgaacgaccttctgcaaaacaccttcatcaaggcatggacaaatattgattatttccgtgccgaggcgaagctgtctacgtggctctaccgtattgcgctgaatgaatgtcttacttttctgaacagacagcgtgctacaacgacggtagctatcgatgatcccgaagcggcgatcgtgcagaaactggagagtgatccctactattcgggcgatcaggtgcagatgctattgcaaaaagcattgctcaccttgcccgaaaaacaacgaatggtgttcaacctgaagtattatcaggaaatgaagtacgaagagatgtcagaaatctttggaacttcagtcggagcgctgaaagcctcctatcaccatgcggtgaagaaaatagagaagtttttggaagaagtagattaaaccttttaaagcagacattgtctaatcaaaagagaggagaaaaacgtatgaaagaagaagataccctattgaagaaaatcggaaaggagcattccttcaaagtgcccgacggttactttgaaaatctgacttcagaggtgatgaacaaacttcctgaaaaagagaaagttgctttcaaggaagagcatatttcgacatggacgagattgaaaccattattctatatggcggctatgtttgtaggagctgccctgattatccgggtagcgtcatcagaccataaaccggcggcagatgatatagcggtgacagtagcggctatggaagcggatacggaacaggtatccgatgagatgattgatgttgcgttagaccgtgcgatgttggatgattattcgttatacgtctatctgagtgacgcgagtgtagaatgatttattaaacagattgaataaaaagatgaagaaactaatcgctttagtcgttttgttatgtggctttatgcctgttctttgggctgccgatggatgtgaccagcatttgtcccgtgaggatttccggaataaacagaaagcgtttattattgagcaggccggattaaccaaagaagaggctgccaaattcttcccggtttattttgaactgcaggagaagaagaagaagctgaacgatgaatcgtggagtttaatgcgtcaaggtaaagacgacaaaacaacagaagcccagtacgaagaaattgtagcaaaggtatgtgacaaccgtatcgctgccgaccgtcttgataagtcttatctggaccggtttaaaaagatactttccaacaagaagatattccttgttcaacgcgcggagatgcgtttccatcgggaaatgctgaaaggcatgaaccgcaaggacggaggaaatgatccgaacaggaagaaataaaacggaggttctgtttggatgaaacagacgctctgtcagagtaaatcagaggctctatccgcatggaatagagcctctgatttttgtttccggatttatctttgttgctttactaaactaaaagagtagaccattggaagtgggaataacagagtttggataggtatcatatccgttccataaggaaggaggatggtgttacagtccttttctcttagcttcgttccaaatagcgtccatctcctcaagagacatatctttgaggtttttcccttcttttatcgtatgttcctccaggtagttgaaacggcggatgaacttttgattggttagttccaaagcattgtccggattgattttgtagaggcgtgccgcattgatgaggctgaacatgacgtcaccgaattcggcttctgctttctctttgtccatgttggctacctctacctggaattctctgatttcttctttcaccttatcccatacctgttcccgttcttcccagtcgaagccaacattgcgggctttgtcctgaatgcggtaagccttgatgagtgaaggaagtgcggaagggacgccgcttagtacacttttgtttccgtctttctctttcagtttcagctgttcccagttttcggatacctgtccggcagtctcagcttttacttctccaaatacgtgaggatggcggaaaatcagtttgtcgcacaacttgtcacagacatctttgatgtcgaagtcacctgtctccgaaccgatctttgcatagaacgctacgtgcagcagtacatctcccaactccttgcaaatatcttttttgtcatccctcatcaaggcatcacaaagctcgtaagtctcttctatagtgttggggcgcagactttcgttcgtctgcttgcggtcccacggacatttgacccgaagctcgtcgaggatgtccagaaagcggccgaaggcttccatctgttcttctcttgtatgtatcattcctttgatttttttataaataatgttgcaaagataatgcttccttgtcttttatagccttaatcggtacgaaaacaaaagcaaggacgctaataaaagtctttttattggtctgatgcggttttcgctttccatacttgatacgaaatcaacagcccgatcacttccgaatagttttttcttccgctttctattttgtttcctttcaggtagaggtcgtatatccagttttgaacatcaccgatcaacggactgtatttagccatccagtattcctgattctttttcgccagttctataatctccggtcggatacggttgattatatcggcgtattctttttcactcaacagtcgtcgggcattccccagtacatgattcagaatcgagaagtagccgctgaaacggattccctttatttgtgaacgggtacaaacctgataggcatagaaattggcctctgcctcgctcgaaattcccagcagatgagccagttcgtgagtgtacgttgccggatagttgatggggagcaagtctccgtttaaggtgaactcgcagaagaaaggccccatgcttcccgttactccgaccattgatatgaatggggtgaaaaccatcgtctttacccgtggattgggaaatggcgggcggtgcactcccaggctgtcgcttaattgattgtaaagtttgacagcttcgtcacgtacctgttcctcatggattccttttacgggaacaaacgaactgttcagtgagtcgatatagtcatccacaaactcttgaaaaatctccggtgtgtaagctgtataaggaatatgcgtacgctggtaaaagtttggttgcgaatagtttaatccccaggcgaggtagaaccatacgtaaacccataacagatattccccgtcacgtagcagaatccttttccacggcagtttcttgcggatacgggcataaaaaggataaacgatgactcccgtgatactcccgaaaataaatagatcccctatggcaaaaggaaataagttggagaagaatgacaatacgcgggagatgacaggataaacggtttgtgaatacaggtttcccaacgcgggaatcgactgtgtcatccataccagaagcagcagtactcccaggagtatatatctaattatcagtttccgtttcatcatccgttcagattttagtcaacaaaaatatgcattaaataaacgtcacgcgaaaaaatacctctatatttgcaaaaaaactgttaaacgaaagatggctaccgtagaagaaattgaaaagtattgccggaattgcgtgtcacgtgatttcgtgaatgggaaagggcttgtttgcaaacgtaccagagagcttcctgactttgacgaagaatgcgaaaacttcgagaaggatgaagaactgttgaagatggctcctcccaagcccgacgactttccggtgtcaatgacggaagaagaacttctcgccgaagaaaatcttcccaaaggagtgctgtatgcatccgtcgcatgtatcttgggggcggtggcatggagtctcatctccgtttctacaggtcttcagatgggatatatggctatcggagtcggattcctggtcggtttcgccatgcggcaggggaaggggatacgtcccgtcttcggtcttcttggagcagcactggcattgatcagttgtgtgttgggtgatttcctatccatcatcggctttgctgccaaggattatgatatgacctttttcgaagtgctggcgggagtcgattatggcgaaatcttttctgtcatggtgaagaatgtggtgtcgatgtccgccttattttatggaattgctgtttatgagggatataaattatctttccgggcacagaaacatcctgtgggtggtaagatttgaattaaaattattaattttgcagccgttattttttgaatatacattatcatatacataaagaaacatggaattagcaagtaagtacaatcccgctgacgtggagggaaagtggtaccagtattggctggaacaccgtttattcagttcgaaacccgatggtcgtgaaccttacaccatcgtcattccgcccccgaacgtcaccggtgtgttgcacatgggacacatgcttaataataccattcaggatattttggttcgtcgtgcccgtatggaaggtaagaatgcctgctgggtgccgggaactgaccacgcttccatcgctaccgaagcaaaagttgtaaacaaactcgctgcccagggcatcaagaagacagacctgacacgtgatgagttcctgaaacatgcctgggactggacagaagagcacggaggcattatcctgaagcagctccgcaaactgggtgcatcctgtgactgggaccgcaccgcctttactatggatgaggaacgcagcaaaagcgtattgaaagtatttgtagacttgtacaacaaaggattgatttaccgtggtgtccgtatggtaaactgggacccgaaagcgttgactgccctttctgacgaagaagtgatctacaaggaagagcacggaaaactgttctatctccgctataaggtggaaggtgatccggaaggccgctatgcagtagtagcaacgacccgtcccgaaacaatcatgggcgatacggcaatgtgtatcaaccccaacgaccccaagaacgcatggctgaaaggaaagaaagtaatcgttccgttggtaaaccgtgttatccctgtcatcgaggacgattatgtggacattgagttcggtaccggttgtctgaaagtaactccggcccacgacgtaaatgactatatgttgggtgaaaagtataatctgcccagcatcgacatcttcaatgataacgggactttgagcgaagctgccggattatatatcggtatggaccgtttcgacgtccgcaagcagattgagaaagacctcgatgctgccggattgctcgaaaagacagaagcttacacaaataaagtaggttactcggaacgtaccaatgtagtgatcgaaccgaaattgtctatgcagtggttcctcaaaatgcagcattttgccgatatggcattgcctccggtaatgaacgatgagttgaaattctatcctgccaaatataagaatacataccgccactggatggagaacatcaaagactggtgtatcagccgtcagttgtggtggggacatcgtattcctgcttacttcctgccggaaggtggctatgtggtagccgctactcccgaagaagcgctggcaaaagccaaagagaaaacaggaaacgctgctttgacgatggatgaccttcgtcaggacgaagactgtctggatacttggttctcttcctggttgtggcctatctccctgtttgacggaatcaatcatccgggtaacgaggaaatcagctattactatccgaccagcgacctggtgaccggaccggatatcatcttcttctgggtggcacgtatgatcatggtgggttacgaatatgaaggaaagatgccgttcaagaacgtttactttacagggatcgttcgcgacaagctgggacgtaagatgtccaagtcactcggcaactcacccgacccgttggaactgatcgacaaatatggtgccgacggtgtccgtatgggaatgatgctggcagctcccgccggaaacgatattcttttcgacgacgcgctctgcgaacagggacgtaacttctgcagcaagatatggaacgccttccgtctgatcaagggctggacggttgacgataatattcaggcttcggatgctgctaaactggctgtccactggtttgaatccaagcagaacgaagtagcagccgaagtagcggacttgttcagcaaataccgtctgagcgaagcattgatggctgtttataaattattctgggatgaattctcttcctggtatctggaaatgattaaaccggcttacggacagggaattgaccgtaccacttatagcgctactctctgcttcctcgataacctgttgcatctgcttcatccgtttatgccgttcatcacagaagaattgtggcaacagatgtacgaacgtaatgcggaagaaggagaaagtctgatggtaagtgcattgagcatggatacttatgtagacaccgcattcgttgcacagtttgaagttgtcaagggagttatcagtaatatccgcagcatccgtctgcaaaagaacatagctcagaaagaaccgcttgacttgcaggtgctgggcgaaaatccggttgcagagttcaatgcggtgattcagaagatgtgtaacctttcttccattacagtggtagagagcaaggcggaaggtgcttcttccttcatggtaggaactaccgaatacgctgtgccattgggcaacatgattgatgtagaagccgaaatcgcccgtatggaagctgaactgaaacataaggaaggattcctgcaaggtgtattgaagaaactcagtaatgagaaatttatcaataacgcccccgcagccgttctcgaaatggaacgtaagaagcaggccgatgcggaaagtatcatcagctctttgaaagaaagcatcgcagctttaaaaaaggcataatgaactgatacataaaaatatgtaatggagaggcatcccgatagatttgggatgcctttctttttaaaagataaaaataatactatctttgcttccacttttaatcacacagcaaaatgaaacaattactgcgaatatgcttaacaggtgcgttctttcttcttttcgaaggactcctttcccctatgttggcagataatgggaaatcagataaagaaatattagttttgaattctattaacttcaaccttccctgggccagaaacttctattggtatgtgcacgatgttcttcaggaacagggaataactgccagagcggaatcattgtctgtcccggccttgcaggatacgatggaggtaaatgcagtcatcgagcatctgcgtcagaaatatccgcttcctcctgccgctgttgtgataattggtgatccgggctggattgtctgtcgtcctttatttgatgacctatggaaagatgttccagtgatcataacgaactcccgtgaccgcctgcctgctaccttggatattctgctctctcatgcctcgttgaatgagaccaacagcgtccccgcccaagagtggagaaaaggctacaacctgactaccctgaaacagcattactatgtgaaggaaaccgttgaactgatctatagcctgatacctgatatggatcgcctggcatttatctcggacgatcgctacatcagtgaagaaacccgcggagacgtgaaagaagctgttgaaaagcattttccaaacctgcctttagaattgctttctaccactcacttgtcaacagaaatgcttctggacaccttgcgcagctataaagcaaacaccggaattatttattattcctggtttgagtcgcataataaagaagataataattatctttttgatcatattcaggagattatcaccaattttacgtcctctcccttgttcctgctttcttccgaagacctgtccaataatacttttgcaggaggctattacgtttctgcagaatcattcggcgattccttacttgaaattattgaccgtgtgttgcatggagaacaggcggaggacatttccgaaagtataggagggaaggcgagtgcctacctctgttatccggtgctggaatcctacaatattccctatcacctttatcctgaacgagctgtttatgtcaacgaacctaaaagtatatttcatcaatactgtgttgaaatcctttcctgttccattttccttcttattttgatagcagcgatcgcctattatatacgtattcttcgcaaggcatacactcgtctgagtgaggcaatggaaaaggcggagcaggcgaatcagttgaaatccgcctttctggctaatatgagtcatgaaatccgcactccgttgaatgcgattgtcggcttctcgaatatgttgccggatatagaagatcgtaaggagatgcgcgaatatgcggacatcatcgaaacaaataccgacttacttcttcaactgatcaatgatattctggacatgtccaagattgaagccggcacttttgacttctgcccgtcattgatagatgtcaaccagacgatggaagaaatcgaacagagtatgaggcttcgcttgaaaaaagaaactgtcactcttacctttaccgaacgtctgccggaatgtaccctttatacagataagaatcgtttgatacaactgatttccaactttgtcatcaatgctattaaatttactcagataggttctatcagaatgggatatcgtctgaaagatgccgatacaatttgcttttatgtttcggatacaggctgcggcatgtcagaagagcaatgcaggcatgtattcgaacggtttgtgaaatacaatccttttgttcagggaaccggtttggggctttccatttgtcagatgattatcgaccgattaggagggacgattggagttgaatcggaagaaggcaaaggctctactttctggtttacgctgccctatcagcaggaatagcatcgtatttgtcttcttatcctttatgattgttagttttatgtattgcagacttccaagactttgatcagcttattacgatgagacaatattctcaccgcaatgagaaaaaattctcaatgcaatgagaaaagattctcactgcgatgagaaaaagttctcactgtggtgagaaaaaattctcatcatgatgagaatggttgagaatttatgatctgtatcagcttgtactatagataaatacagatttactgctttctgttttatagctttaattgatagagcaaaaaagaactttacctaaaaagaaaccgtttttctctatttagttgaaggatggtataggtttaataggtacgaatccaatttattggaaggagtcacttatattaaggaaacagtaaaggaagcagcaatggcagataatcttttaaatcgatgcgtaattgcttgagtgcttgctgaatacgataatctacagtctttggagacacttccaatgtttctgcaatttctttgtagctcatatcccggaaacgatgcatgacaaatgcttgccggtaactttccggcaatgcagcaaccgcgtcttcaattcgtttggttagctctttaatctgataaaagtccatatcatgtatcatctcttgcatttcttcatagaaacgcgtatcagcacgtttgatggcatcaatgtgtgcaagcttatttaaagccttgtgatgtaccattttaaagagataagaacttaatgatgattcaatgattaagttttcccggttttcccatatccatagaagggagtcttgcactatttcttctgcatcgtggaagtcaacgtatttatgaccataggcacatagcactgcatagtattgcctgaatagcgtttcaaaggcttttaggcctccacgctgtatttcagataattgaagatcattcctctttatgcgtagttcttccatttattaaatagttatttgctgcaaatatagcttttttataataaaataaagattttctgaaaaaaataaggttttcgtttaggaatgtcctggtttagccttgtcatataataaaaaggtggaataagggatgaaagatttaaataataatagaatagaagaattgcttcctcgttattgtgaggggaggctgagcgagggggaacgtctggaagtggaagcgtggatggacgagtcggaggagaataaacgagttgctactcagacttttgctctttatttggctgtggacacggttcaggtaatgaagaaagttgatacggagaaagctttactgaaagtaaagggaaaaatgtcggaccgtgaagtgagaaggacagtgtggtgggagtgggcacaacgtgctgctgcaattctgtttatcccgcttcttaccttatttatatggcagaactggaaaggggataccggagaggtagcggagatgatggaagtaaagaccagtcctggaatgacaacttcgttgacattgcccgatggtacaattgcttatttgaattcagaatcttctttgtcttatccttctcgctttaatggtgatttccgtaaagtgaagttaagtggtgaggcatactttgaagtagccaaagatccggaaaagaaatttatcctttctactacacatcaatcacagatagaagtcttgggtacatgtttcaatgtggaagcatatgaacagaatacagaggttattacaactttgattgaagggaaggtagattttatgttcgaaaaagatgctgtgatgaaacatatcatcttgtctccaagagagaagttggtgtacgactcggagactgataaagtccacctttataaaacttcgggaaaatcagaattggcttggaaagatggagaggtggttcttgataatacacctttggaagaagcattatggatgctggaaagaagatatagcgtgaaattcgttattaagaacgaaaaactgaagaatagttcgttcacgggaacctttacaaatcaacgtttggaaaagattctggaatattttaaagtatcctccaaaatacgctggaaacatatcaatgatgacaaggatggaagtgacagaaaaaaagagataatagagatttattgattaacctttaacaatttagtagtatgaaagcaaaacccacttagaaaaaagtatgggaagattttggcagatctccccatactaaaatgaatcaattgaaaatgcttgtttggcagacaagcatagttaactcattttcaacttaaatcaatacaaaattatgcaaaacaattttagcatccaagttttaagggtggtaaagtctttttggctaacctcgaaaaaaatcccacgtactatgagactggttattttattcttattttgctttgtcggattaactaatgcgacagatagctatgcccaatctgcaaaggttacaatgaatgtacgtaatcagacagttgaggatgtattaagagcgatagagaagcaaacagaatttagtttcttctacaacaatgctcatataaatttgaaacggttggtgacaatctccgctgaccgtaatgatatctttaaagttcttgacgaagtatttaaaaatacgaatgtagaatataaggtaatagataaaaagatcattctgtccacggagttggcatctgtcgaacaggcgcatcaggaaaaggtaaaagtgagcggacgagtggtggatgcggcaggtgaaccggtaatcggtgccagtgtgatagaaaaaggctccgccaatggtacgatcactgatatggacggtaattttatcctgaatgtcggttcaaaagaagccattcttgaaatctcttatattggttatcaaggacagtccctgaaagtaactccaggaaagacgctgtcggtagtgctgaaagaggacacacagagtctggacgaagtggtagtagttggttttggcgtacagaagaaagcgaacctgaccggtgcggtatctcaggtaaagatggatgatgtgctggggagtcgtcctgttgtaaatgccatgagtgctttgcagggtgcgatgccgggacttcagattactcctaataatgatgctgccggtccgggacagagcaaatcattcaatattcgtggtacgacttctatcaatggcggtggtccgttggtgttgatagataatgttccgggggatatcgatatgttgaatcccgaagatattgaaagtgtttctgtgttgaaagatgctgcctcggccgctatctatggtgcgcgtgccgctttcggtgtaatacttgtgactacaaagaaggcgaagaaaggagacggttttcatgtcaattataataataattttggtttccagagttctatcaatcgtccggaacaggctgacgggctggagtggatgcaggcttacctggacggcgagttcaatgccggtaaatactacactgggcaagatatcaaaacctggatgaactacctgaccgaatatcgtaagaatccgggtaaattccagactaccggagacggggtatatgtagacccggaaacaggattgaattattacctgaatgagaaagacctgtatgccaatatgcttgatgattacggttttctgcaagcgcataatgtgtcattgagcggtggtactgataagctggcttatcgtctgtcccttggctataatagcgagcaaggtattttgatcaccgataaagaccgctacaaacgtttgtcgggtagtgcctatatttctgccgaaatcacttcgtggctgactcagtctgtagatatacgctatgctcagagtgacaagaatatgcctgtgacttcggataagaccggattgtatgatatgcgtttgccggttgtatatcccgaaggctccctgactttgcctgacggcaccagcctgatgacgaatacgccttccaacgttttgagaatggcaacggataacaatacaatcagagacaatgcccgtatcctgtcaaaaacggtattgaaaccattgaaagggcttgaagtggcattcgaatatacttttgacaagacatggagtaatcagaatgtgaataaggcttccattgattatacaacggttgagctggcaaaaatacagactgccactacctcttctctggagacgactcaccaaagtactgattataatgccatcaacctgtatgctaattatagatattcatggaatgacacacataacttgtcattaatgggcggcttcaaccaggaatccagtgactggaagaaattgtatacttattcttatgatatgattaacgagaagtatccgtcacatagtacggctaccggtgagaataaggttattacagatgatcatcgcgtgtataccgttcgtggtgctttctatcgtgttaattatgattataaaggcaaatatctgtttgagaccaatggtcgttatgacggatcgtctaaattcccgaagaaaaatcgtttcggtttcttcccttctgtatctgtgggttggaacattgcccgcgagaactttatgaaaccagttgcaggtgactggctaagcgatctgaaacttcgcggaacctggggacaaataggtaatcaaggcattgatccttataaatttgttccgaccatgtcgcaagtggaaaagaaggatgtggcatggctggtgaatggagcgaagccgctgactttgaatgctccgggactggtcagtgatagttttacttgggaaacggtagaaacattggactttggttttgatataactgccttgaacggacgtctgcaaagtactttcgactggtatcgccgtgatacgaaagatatgcttgctccgggagctgagttgccgtcagtggtaggtgcttccgcacctttgcagaataccgccgacttgcgtacgaaaggctgggaattgtcattgacgtggagagatagaatcggtgcatggggctataatgtaggcttcaatctttatgactctaaaacagtcgttaccaaataccataatgaatcaaagattatcctgaaaagtgatggcacgaataattattatgaaggatatgaaatcggttctatctggggttatgtaacggatggttactatacagccgatgactttgaagatacaaatacctggaaactgaaagaaggagtggtgacagtggatggagtaagtccgcgtcccggtgacatcaagtaccagaatttgcgtgatgatggatcgagtacgaatcgcattgatacgggagacggaacctttgacaatccgggtgaccgcaagataatcggtaataactctttgcgtttgcagtatggtataaacctgggagtcaattacaaaggatttgatctgagtgttttgctgcaaggagtaggtaaacgtgatgtatggatcagtgatgcacgccgctggccgtttaattccggacagttcggttcactctttaaagaccagctggattattggaaaccggtagattctgccaatggcgactggacggcagccaatccgaatgcggaatacttccgtatttacgggcaaggaaacaattccagttacaatacacgtgcgcaaacgaagtatctgatgaatggctcttatctgcgtgttaagaatgtgactttgagttataatttcccgaagagctggttggcacctattacattaacgagtttgaaagcgttcgtaagttgtgagaaccttcacacatttactaagctgatgaagggttatgacccggaacgcctgtcatggggatatcctttctatcgtacgatttcttttggttttaatgttactctttaatttagaattggttatgaaaaaaataatatatactatgcttgcggcagcagctatcggatttacgtcatgcaacgatagttttatggaacgctatccggatacttcgttgacggagcagacagtgttcagtaattataatactttcaagacctatgcctggggattgtacggagtatttacaaatactaatatcctgcgtattcccggtacaaacggagcctatgccagtgccacatcctatacaagcgatatttatgcaggttatctgatgcgtcgtcagggtgacggtaatccgtatgcttttcagaatgtatccagttcgtcatcgggcaatggatgggcattcagtttcgtctatcgggtcaatgtcatgttggcaaatatcgataactcagggatgacggatgcggacaaggagcattggcgttcggtgggatatttcttccgtgcctattattattcggaactgatagctcgttttggcgatgtgccttgggtagatcgcgtactgggtgattcggataaggaaatagcatatggtccccgtacacctcgcaaagaagttgccgatcatgtattgaacgatttgatatacgctgaagagcatataaaagaagaaggtgacggtgaaaatacgatcaatgtgcacgttgtccgtgctcttctttcccgtttctgcctttttgaaggtacatggcgtaaatatcatgctttgggggacgaagataagtactttgatgcttgtatcacttattccaagaagctgatggattcttatcccgaactgaacagtgactggggagagatgctgacatctgacctgaaaggaatgaaaggcatcattctgtataaggaatatgtagaaaaagaactgactaattatgtactgacgcatgttgaacggacatccacccataatgtggaaatgccgcaacacatcatcgacatgtatctttgtaaagatggtaaaacgatccataacagctcggaatatgaatggtcgcaggatggggataatagtatgaatgctaccttccgcaatcgtgaccttcgtctgctggagactgtagctcccccttataaggtgatcccaagtgccgataataccagttgggagtatacttctgatcccaaggaccgtgagtttatggatatcatgggcattacccgttacacaggtttcgggggtggaaatggggaagccggtaaacataaagtgttcccattgatgaactggtctgctgctatattgaaagggatgcctcacttcttcaccaacaatggcggacaaggtttcctcgtagcccgtagcggtaactatgtgtacagatactataatgtttgggataattcgaaagagaatgaagggacctcagatgtacctttgttcaagattgatgaagtgatgttgaattatgccgaggctaaatttgaaaaaggtggtacaggtgccgaaggcttcaatcagacagttgctgatcttactatcaataagttacgcgatcgggtgggagttgcccatatgaaagtggccgagataaatgccggatttgatccgaagcgcgaccagaccgtagaccctgtattgtgggagattcgtcgcgagcgcatggtagaattgatgggtgaaggatttggattctacgatgtgcgtcgttggaaaaaggcaccttggtttatcaataagatacagtacggtcaatgggctactaaagagcagattggcgactccggacagtttgttgatcttgaaaaaggatacgccgatacgacaggaaagaaagaaggttttatctatatgtataatgatcctttggtagcaggtaaaggttggttagataagtattatctgtatcaggtgcctactaatgaaatcgcattaaacccagaactggcccccaataatccgggatgggagtaataattaactgaaacacaaattgaaagaagatgtgcaaataactgtttgacacatcttctttctttattagagccaatgctatccgtcggaaacagtcggtgagtcaaccgaatatttccgacttttcatatattggaggttatttaatgtgtatcagtataaaagaactacattttattttcagtaatcggaaatttgaaatatatttagaggctcaaacgctcaaacacatttgatgacccttaaaaaaataatgactatgaacatgcgtcttctattacttttattatttggttctgttgttatgtatacaagttgccaatctacgtctgctccaatcgattcattggcagcacgtgtgacggagaatacgtcgaaggatcaaatccttttccggttggttactgatgaagccgatccggcaaaagactactttgagatagactccaaggatggcaaagtactgataaccggaaactccgatctttcactggctacgggcttgaattggtacctgaaatacgtggcaggtattcatctttcgtggaataatccctcgcagaaattgccggaagtactgcctctgcctcaaaagaaaatccgacaggcgacggctatgaagaatcgatattacctgaattactgtacctattcctactccatggctttctgggactgggagcgctgggagaaagagatagactggatggcgatgcacggcatcaatatgcctttgagtataacagggatggaggttgtctggtataatctgctgaaacgtatcggatatacgacggaggagatcaatgagtttatttccggtcctgcctttatggcatggtggcagatgaataatctggaaggatggggcggaccgaatcccgacagttggtatcggcaacaggaagcactgcaaaagaagatcattgcccgaatgagggagctgggcattgaaccggtattccccggatatgcaggaatggttccccgtaatatcggagagaaattggggtatcagattgccgatcccggtaaatggtgcggtttccctcgtccggcctttctttctacggaagatgaacatttcgattcatttgctgccatgtattatgaggagttggagaaactgtacggaaaagcaaagtattacagtatggacccctttcatgaaggaggaaatacggaaggagtagacttggcaaaggcgggaacttctattatgagtgctatgaagaaagcgaatccggaagctgtgtgggtgatgcaggcatggcaggcgaatccgcgggaagcgatggtcagtacgcttgattccggtgatttgctggtactggatttgtatagtgaaaaacttccccaatggggtgatccggagtcgatgtggtatcgggagaaaggtttcggcaagcatgactggctctattgtatgttgcttaactttggcggtaatgtcggtctgcacggacggatggagcaactggtgaatggatattataacgcatgtgcacatgtcaacgggaaaaccctgcgaggggtaggagctactccggaaggaatcgagaataatccggtgatgtttgaattgctgtatgaacttccttggcgggaagaacggttcgcaccggatgcatggctgcaagcgtatctgaaagcgcggtatggaaatgatttgtcaccggaagtagcggaagcatggcgtgcgctggaacatacagtttacaatgctccgaagaattatcagggagaagggacagtcgaatccttgttgtgtgcccgtccgggatttcatcaggacagaacgtcgacatggggatatgctaagttattctattcacctgattcaacggcaaaggcagcccgcttgttactttctgttgcagatcagtacaagggaaataataactttgaatatgatttggtagacgtggtgcgtcagagcctggcagataaggggaatgtgctgcttgaagaaatttctcagagttatgatcggaaagataaggatagcttcgggaaacagtcacaacagtttctggagttaatattagctcaggacagtttactgtccacccgaaaggagttctcggtgtcttcatggctgaatgccgcacgttctttgggaaccacggaagaagaaaagaaactttacgaatggaatgcttctgcgctcatcacggtctggggagacagtatagctgccaatcggggaggtctgcatgattattcccatcgggagtggagcgggattttgaaagacttgtattatcaacgttggaaaaccttctttgagcagaaacaacgggagttggacggtaaacttgaccaatcagcggaagaaccgattaatttctatggtatggagaaagcatgggcggagaaaaacaaaacagctgattcatcggatcataagtcacaaactgtaattgaaacggcaaaatctgtttatcggacagcgattgaagcaaagtaatttatctacctacactgcttcggctttcagctagagggctgactaaaaagtcggtagtgctgccttaaatgggagtgactaaaagtcgatagtattttaattctcctccttcgggaaggaggagtacccgcagggggaggtggtaggtgaatacgcaattctttcattcatagtaaattagatacaaccttgttttacctaccaccccggctttcagccacccctccttcccgaaggaggggagttttagatactaccgacttttagtcattcccatttaaggcactatcgacttttagtcactcctaatagggaaacttgagtttgtacgaatcatataaaacgaaaaaagaataatcggaagtaaacaggggaataccttttacttccgattattctttttataaatgataattgcttcggcaaggccatgccgtgcaatcgaacatagttatttctccaacaagtttttcagaaactcgtccagttctttatccagccctttcagcagttcgtcatccacgagcaacgtatcatcgtctatcagcaacagctctgcaactgtttccttatcttcatctaccagtacgaatgaataaggctttaatattgttactttatcgaagtcgcctgcatctttcattctgcaaagggtacttttcaggttgggctttacattttccatgaaatcatctccatcgtaagtcgcccactcttcaatcattacattagccaattcctcgtcatcgtcgttataaatagtgagttgtcccgatgtttggtccggttgtaaatgaatatcggttacggctgtctggtcgcagccacatacatatttgccggctgccttttggatagccgattcgatggtagacagagattgttggctcagtttcataggttcttcctttttgttacctcaaaggtataaaaaaaataataatcaatgcatgatttccttaaaaatcatcattaaatcgctccatttgcatttttagcttgggcaattgactgttacgttccttcaattcatttgcataaagggttgtaaggtagtaattcggtacatcgtcaatggtggcgtacgccgcattttcgggaatgtttttcttatctactttttgggcaagttgctgtgctttgactgcccattcttctgcttttgccaagctgtctttcatctcataataaacagcgatattgagggcagctttcatctttttcttttccttcttggttccgttgtacacttgttcccaaagttcgaaagctctgtcccatgaattttcacggacaaagattgccgcgtcacgcatctgtacggagccgccggtgtacaagtatcgtttgcctgtcttccagaaagggagtagctgtttgacagggatagtccctgcaaattcagaagcttcccgtagcatctgtgcatcaggtatcatgtgtgcaaatgtttctgttaccgatcctccgtattcttcccaaaagatactgtcggtggggtgtagcgtagtcatcggtttgctgcgtgagggcaggtatactttcaccgtcgggtaggcttttacatccactgtccccaggtagcagttaaaatcacggatataacgaaccgttttggtcgctttgaattgcaggttttccatggcgatgatacagtccactcccaagtctgatgtcagctgttggacttcctcctgactcagtgtactttcacgaggaaacttgtcattggcccgtaaagcggaatcacagatcaccactacatcgaaatagttctgatgcgcgatttcttccgccagcgattcagccgcaatcttaacgttaccattggcatacgctgtggcgtggcttatttcgggtacgttttctttcggcttttcggtctgtgtgatcagcttgttatccggttcggtgctggtgttattcacgatagccactttacggagttgagaagggaaagtcatatctccgggctgcatatagtcaatagaaatctgctccaggctttgacagctgccgaatgccaacagtagcagagaaacaaatgccagtgaatagaattttgccatagtcttgatatctttagtagtttaagcaaaagtactattttggatgaataaaagaaagcctcaaacagtttttaaccgtttgaggctttcttttagattataatcttacatcggactgctgttaagcattctgtccgtggcagtttttatatttcttaccgcttccgcatgggcaaggatcattgcgtcctaccgtcttttccgcacggatcggttcgcgtttttgttgctcgcgagtatcctgactggcagcagcctgctggttcggatcactgaggtcttgtttctgttcacgatacttgctcatatcctgacgttgctcgggagcagcctggcgtacttctacgcggcgtggctgttgttcgtctgccggagcttcctgtacagggatctgtccgcgcatcaggatggagatagtttggttattgatcttgttcaccatagcgtcaaacagtgttacggattccagtttgtagatcaacagcgggtctttctgttcgtagcttgcgttctgaacagagtgtttcaactcatccagctcacgcaggttttctttccatgcttcgtcgataacgtgcagcaggatagacttttcgaaagctttcaccacctcctttgattcggactcgtaagccgctttcagattgcaggagatgttatacatccgttttccgtctgtgataggaatcagaatgttttcgtacatatgtccctggttttcgtatacttgtttgatgaccggattagcgatttgtgccaggcgttccgttttgcgtttgaagttttccatggcaatgttgaatgtcttttctgccaatgtgtccttcttttcattacggaattcttcttcggtgaacggagtttccatagccaatgtctggagcagttccatctgacagccttcgtagtcattgttctcgatcgcattcgcgcaacggtcccagatcatattaacgatatccataccgatacgttcacccatcagggcgtggcggcgtttggtataaacaacggtacgttgcttgttcatcacgtcgtcatattccaacagacgtttacggataccgaagttgttttcttccaccttcttctgtgcacgctcgatagagttggagatcatcttgtgctcgatcatttcgccttcctggaaaccgagtttgtccattacactggcaatacggtcggaagagaacagacgcatcaagtcatcttccagtgacacgaagaatacagaagaacccgggtcaccctgacgtcctgcacgaccacgcaactggcggtctacacgacgggattcgtgacgttccgtaccgatgatggccaaaccgcctgcggcttttacttccggactcagcttgatgtcggtaccacgacctgccatgttggtagcgatggtcactgcacaactgaaaccggcttttgctacaatttcagcttctttctggtgcaacttcgcattcagtacgctgtgttcgatcttacgcatggtaagcattttgctcagcatttcggagatttctaccgaagtcgtacctaccagtaccggacgtcctgcctgcactagtttttcgatttcttcgataacggctttatacttttcgcgtttggttttgtaaacgcggtcgttcatatccttccttgcgatcgggcggttagtcgggataacgactacatccaatttgtagatgtcccaaagttcgcctgcttccgtttcggcagtaccggtcataccggacagcttgtgatacatacggaagtagttctgcaaagtgatcgttgcgaaggtctgtgtggcggcttctactttcacacgttctttcgcttcgatagcttggtgtaatccgtcggagtagcggcggccttccatgatacgtccggtctgctcgtctacaatcttcacctgtccgtcgatcacaacatattcgtcatctttctcgaacatggtgtaagccttcagcaactggttgatggtgtgtacgcgctccgatttgatggcgtagttagtcagcagctcatctttcttttccagcagttgttcgttggtcaggttttgattttccagttcggagagttgtgcggcgatatccggcagcacgaacaatgtcgggtcttcggagttaccggtgatcaggtcgatacctttatctgtgaggtctacgctgttcagtttttcttcgatgacgaagtacaacggttcggtcacttcgtgcatacgcttgttgttctgctccatgtagatttcttcggtcttcagcatgccggctttgataccctgttcactgaggaacttgatcaatgccttattcttcggaagacacttgtggctacgataaagggcaaggaatccttcttccacttccttcttgtcgttggaggcaatcagtcgtttggcttcggaaaggtatttggttgccaatgctttttgagcttctaccagacgttctaccagcggacggagctgttcgaacagttggtcgtcgcccttcggcaccggaccggaaataatcagcggagtacgggcatcgtcaatcaataccgagtcaacctcatcgacgatggcgtagttgtgctggcgttgaacaaggtctttcgggctgatagccatgttgtcacgcaggtagtcgaaaccgaattcattgttggtaccgaacgtgatgtcggcaaggtatgcctgacgacgggcgtcggagttcggctgatggcggtcgatgcaatctacgctcaaaccgtggaacatataaagcgggcccatccattcggagtcacgtttggcaaggtagtcgttcacggttactacatgcacaccgtttccggtcagcgcgttcaggaataccggaagggtagcaacgagagttttaccttcaccggttgccatttccgcaatcttacctttgtgcagaacgacaccaccgaacagctgaacgtcgtaatgaatcatgttccataccgtatcattgccgccggcattccagtggttctggtagatggctttgtcgccttcaatgcgtacaaagtctttggtggcagccagatggcggtcgaattcagtcgcggttactacgatttcttcgttttccgtaaatcgtttggcagttgctttgacgatagagaaagctacgggcaatacttcttccagtgctttctcgtatttttcgagaatttctttctctatcttatctatttgtgcaaagacttcttcgcggtcttccagttcggtgctttcgatgctcgctttaagttcttccactttagcgcgttcgtcagtagccgattcgcggatgtattttttgagttcttccgttttggcacggagggcatcgttgtccagtgcttcaatctccgggtaggcagctttgatcttttctacccagggtttgatttctttcatgtctcgtgtggatttgtttccgaaaatcgagcttaaaaattcattaaatcccatgttgtattatttagtttattattatttcttgattgtctgcacggtgctttttccatatataaatccgcgcaaagttacattaaaatgctgatttatttatgtttttcgcatggtttttgtgaggaatcttttaccgaagatcggtaataggagccgaagaagaagcattgggagcccgtatgcgcatgaaatgagccagtgtaggcgcaatatggtcgattgttacaggtgtctgaatgatggccggtttcacggagtgacccatgaagatcagcggtgcggggatataggaatgacgtaccaccttgttctcgttgccgttttcgctgacgatagtccatcccggcaacacgtcgatcacgaggtcgccggaacgcttgcggtgatagccgttgcgtattctgtatatttccggagtccatgaacccaggagaagtcggtgggcggaatatgcctcatttactccgctgaactgcatcaggaagtcggcagacttttcctgcacttctgtcaggttcagttgcttttgttccagtaacttgtggttcagatagatttgctggtcgtgataggcttctacatattttccttcgccgtaagtggccatcagaaacatgttcagcaaggcggtgcagcggttgaggtgaaactctccggtcggtattttgtacagtcccgaatccgtcgattcgctgtccgtatatccggtggaagtgacgaagataagcacattctgcaagcctactttcttgtcgagcaggtcaagcaggttggcgatgctgcggtcgaggcgtacataagtgtcctgtatttccatggcacactcttgtacggacttgtgcgcatagttgcctgcataataagtaagtgccaataagtcagtaatgtcatccatgccgaccgaacctttgccgattgcttcttctgcgagggcatttacttcatcgttgacgaacgggctggtgatgaaacggcggaacttattgttgcggtcgtcgtcaaatttatatttgaacactacgtcccgccaatctggcaggaaagtgtacataccacgtgggaaaaccggttcccatgtgacgctggagatgcgggagtcgatggcctgacggtcgttatattggcttgcccaccaggggaattcgccataataagtcgttccgctccattttccggtcgtgggattgatccagaacgctccgtttcctgcatgtccggcagcgaaaatggctgcgtcgcagaaaggggcgatggcgtatacgatacctttgccttgtgtcgctattttcagttcgtcggcaatggtagaggttaataatttggtaggggcacaggtctgatcggtgtaataacccatgaaggccgcatcgtccgtactgttgacagggcgtagggtagctacatccatccatcggttggaaatgatcccgttgacggaaggcgttgatccgctgtagatggctgccatggcagaggcacggtctacaccgctgaatgtatattctgcattgtggaatactcttccctctttccaaaggcgtttgaagcctctctcgccgtagagcgacgaaaaagcttccagatagtccgtacgcaactggtcaatcgtgagtcctaccacaagtttaggggcagtaggcaacgactgagcttgtagcccggtgaaggtcagtacggtaatcagggaagttagtagtcctttcattatttctttttagaggtcaatatcaaattgctcgctgaacgtatcagcaaacagagtgccaaaggtacaacagctaagtcaaatctctgcggaattagcggaaaaagcaccataaaaagtgttaaaacgactaaattcagcgtcaaataccagcatttctttccttttcggacacaataaatgatgtatggaaggagcagaagctgtcccggatggaataccagcaataagaaattggagctgacagccggatgttcggagaatagggcgaggaaggccagcacacagcccacgatgcctgcggcaccgaataaaataaggtcgacaccccagagtcctgtccttttgcggatgctgtagatagtagcagctgcggtaagtataaaaagcaggagggaacattggaacggggtgggcatccaaccgccttcttcttcctcgggaagggcgtctacgatcagctccttgccggatacgagcggacgctgaaccgaatcatggacgatttgggcgcctgcgaaagcatccatcaggtaaaagggggcaaacatcatttggcgttgcgtgatggggcggtctgcttcgctaccgatgcagaggtcgatgccgaagcgggcccacggatggcctttgcagtattgatgtacgatatcgcggaaagatagcgaaccgtcttgcggctctgcgggatatattacctttccgtcaatgctttcttctattttatcgcgcgggcgtgtagcgcagttgtcataaaagaaattataccggtaaactctgttttcgggaagatagttttcttgcagtagtcggatgagttccgctttttcttctttgctcaggttgagtgtctgttgccagacgctgcgcccgtcgaaggcatattccgccgcgaaacgggcgtagtcggtagctcccagctggtagtctgtctcaccgagtgaaaaacggaggatgaagttgggagtattgaagctgaatagtccatagttgaatacggcatctattccgttggccggatcttcgtagcggatggctgtatgtccgaacagggagtatatttcttcaccgggggcgcaagtcagcaggctgaggcggatggagtcgttgccagaagctatggcttgtccgtttgaaaagataagcagataaagagtcagtaatggatatagaattgtccgtttcatcagaaatgcccgtttattattttggtggcgaatatacgaagaatagttggattgtagaaacggaggcttcgttttatccaaacagaggctttgttttacccaaacagaggcttcgttttacccaaacagagcctctgattagggtaaatagggcctttaaaagcgttctttttttcttataaaatgtggaacgctgaacggaacactttaaaactcttgtaactgattgatatatagggaaatgttgtgtaaggaaaaatgactatgaaacgcaaagcggtaccataataagggataactaataaattatatatttaaaaatatatagttcgattttggcgtttgggggcgatatttgaaatgaaaaaagaagataattccttctgtatgcttcaacttttctttttttactttacctttgcgccgctaaagacgaaaagtattgaacttaattatcgacataggaaatacgacagcgaaagttgccctcttcaatagaagtgagatggtggaggtgttgaccgaatccaatcaatcattggatagcttggaggctctttgctccaaataccggattgagcgggggattgtagctactgtcgtcgatttgaacgaacggatacttgccgaactggctgctttgccgttccccctgttatggctcaatcatgagactccgctgccggtaggtaatctgtacgaaactcccgagacattgggatacgaccggatagctgccgtagtgggggccaacgagcagtttcctcataatgacatcttggtcattgatgcgggcacttgcatcacttatgagtttattgactcgaaaggacaatatcatggcggtaatatttctcccggcatgcagatgcgctataaagcgcttcaccagtttaccggacgcttgccgctgatagactccaacgggcgcaaactgccgatgggaagggatacggaaactgccatccgtgcaggggtgctgaaaggaatggaatatgaaatttcaggttatattgaggctatgaagcataaatatcctgaacttttggtttttttaacgggcggagatgacttttcttttgatagcagcgtaaaaagtgccatctttgcagatagatttttagtgttgaaaggattaaatagaattttaaactataataatggtaggatttaaacacacgatttgggcgcttttgctcatgatggttaccggaacggcaatcgctcaaaataatacaaactctccttacacacgatatggctatggcgacttgtccgatcaaagtttcggaaatagcaaggcgatgggtggaattgctttcggactcagggatggagcacagatcaatccaacgaatcctgcttcctatacggccattgattcgttgacgttcctgttcgaagggggtgtcagtttacagaatatgaatattagtggtggtggcctgaagttgaatgccaaaaacgccagtttcgattatctcgctatgcagttccggttggctccgtggatggcgatgagtgtcggattgttgccatattctaatgtggggtatacggtgtctgatagtcagactacggacaatggtttggcatatagcagaagttttaccggcgacggtggtttgcatcaaatgtacgttggtgctggtgtaaaagtacttaagaatctctctgtcggtgtgaatgcatcttatttttggggagatataacccgtacaagaggaatgttctatccgggaacatcttcttatgattcctatcagcgaaaaatggtaacctcgatttctgattataaattggatttcggtgcacaatatacacaggctttgaataaaaagagttctttgacgattggtgctgtatattctcctaaacataagttgaataatgattatacgtcaattgtaatcatgggagcatctagttcaagttatggaactgaatataaggatgtcttggatgctacatttgaattacccaatacctttggagtcggatttacatataactatgacaagcgtttgacagttggtgcagattatagcttacagcaatggtcaaaaactaattttggcgtagtaacaagtgacgagaatgtacgtcaggactttaatgaaactttcacttattgtgatcgtacaaaaatatcagtaggtgcggaatacattcctaatttgataggacgttcctatttcgcccacataaaataccgtttaggagcttattatacgacaccgtattataagattgatgggaaaaaggcttcacgtgaatatggtgtaactgccggtttcggtctgcctgttccccgttcgcgttccatacttagtatcagtggacagtttgtccgcgtaaaaggactggagacgaacatggtgaatgaaaatatcttccgcgtgagtatcgggcttacgttcaacgaacgttggttcttcaagcgtagggtagagtaataaaagtgagagagagaatagacgatattatataaacaactaaaatttagatacaatgaaaattaaaacgcttgtggctatgttgttcctttcggctggagcaaccactgtggtggcacaggatgcgtctaactgtaactcaaacagtagtatttcgcatgaggctgtgcgtgcaggaaattttaaagatgcgtatactccctggaaagctgtgttggaaaattgtcccacactccgtttttacacttttactgacggatataaaatccttaaaggcttgatggctcagattaaggataagaataatcctgaatatcagaagtattttgatgaattgatgaatacgcatgatttgcgtatgaaatacacagaagaattccttgcaaaaggaactaaagtgtcttctgctgacgaagcgctgggtatcaaggctgtagactatattgctttggctccgaaagtagacgctaaccaagcctatcaatggttgagccagtctgtaaatgcagtgaaaggcgaatcggcagctgctacgcttttttatttccttcagatgtcattggataaactgaaagctgatcctaatcataaagaacaatttattcaggattatctgcttgcttcagaatatgctgacgctgctattgctgcagaaactaatgaagcaaaaaagaaaaactttatgggtatcaaagataacctcgtggctttgttcgtaaacagtggtactgctgattgcgaatctctgcaaagtatctatggcccaaaagtagaagctaaccagacagacttggcttatctgaaaaaagtaatcgatatcatgaaaatgatgagatgtacagaaagcgaagcttatctgcaagcatctttctacgcttataagatagagccaacagctgaagctgctacaggatgtgcttatcaggcattcaagaaaggtgatattgacggtgctgtgaagttctttgacgaagcaatccaactggaaactgataacgtgaagaaagcagaaaaggcatatgctgctgcagctgtattggcttctgctaagaaattgtctcaagccagatcatactgtcagaaagcaattagcttcaacgagaactatggtgctccttatatcctgattgctaacttgtatgcaatgagtcctaactggagtgacgagtctgcattgaataagtgtacttacttcgctgtaattgataaactgcaacgtgcaaaagcagttgacccaagtgtggctgaagaagcaaacaagttgattggtacatattccggtcatactccacaggctaaagacctatttatgttaggttacaaacaaggcgaccgtatcactatcggtggctggatcggagagactacaacgattagataaaatttatgttgcgaaaacgaagtaaccgtttgttgcataaaagcataagcataacaattgccttcggggcaattgttatgcttctttcattttcttcctgcggcggtaagaagaatacgctgggcgacgccatcacagaacgtgattcattaccggtgatgaatacactgggagtaactactcttatatccgactcgggagtgacacgttatcgggtgaatacagaagaatggacggtgtacgaccgcaagaaaccttcctattgggcatttgaaaagggagtttatctggaacaatttgattctatctttaatattgaagccagcatcaaggcagataccgcttattattatgataagcagaaactctggaaactgatagggaatgtagatatacagaaccggaaaggggagcgtttcaataccgagttgctttattggaacgaggcaactcaaaaagtctattccgacaagtttatacgtatccagcagccggatcgtgtaattaccggacatggttttgactccaatcagcaaatgaccgtttatgtcattcagaatattgagggcattttctatgttgacgaaaatgggggaactgctcaaccggaagtaaaagcattgccgccggattcgacgaaaaaagattctgtgaaataaactatgaatatttatatctctttactcatcactatggctttctccgctttcttctcaggaatggagatcgcgtttgtctcagtagataagttgcgctttgaaatggaacgtaaggggggaatcacatcccgtattctttccatctttttcaagaactcgaacgaatttatctctaccatgctggtaggaaacaatatagcattggttatctatggtatattgatggcacagatcatcggtgataatctgttggctggttttattgataaccactttctgatggtgttggcgcagaccgtcatctctactctgattattttggtgactggagagtttcttcctaaaacattgtttaagatcaatcccaatctggtcttgaatgttgccgctattccgctttttatttgttatgtcattttatatcctgtctcgaagttatcttccggtttgtcttgcctttttcttcgtatattcggtatgaaggtaaataaggatgcttcggacaaggctttcggaaaagtcgatctggactacttcgtgcagagtagcatcgataatgctgcgaatgaagaagaattggatacggaagtgaaaatctttcaaaatgcacttgatttctcaaacataaaaatacgtgactgtatcgttccgcgtaccgaagtcgttgcggttgaccttactacttcgctggatgaactcaagagtcgttttatagaatccgggatctcgaagatcattgtgtatgacggaaatatcgataatgtggtcggttttattcattcgtcggaaatgtttcgtgatccgaaagactggcgtgataacgtgaaagacgtgccgatcgtacccgaaacgatgtctgcccacaaactgatgaagctgtttatgttgcaaaagaggacgattgccgtggtagtagatgagtttggaggtacatccggcattgtgtcgttggaagatttggtagaagaaatatttggtgatatagaagatgaacatgacaatacttcctatatctgcaagaaaattgacgaagatgaatatgttttgtccgcccgtctggagatagaaaaagtcaatgaaatgttcggacttgatctgcccgaatcggacgactatctgacggtaggcggattgatactgaaccaatatcagagcttcccgaaactgcacgaattggtacgtgtcggccgttatcagtttaaaataatcaaggtgacagcgacaaaaatagaacttgtacgcttaaaagtcatggaataatggcgataaccgtgaaatttttagctaataaatagaagcatattagcattttttgtatcttcgtgcgctaaaatgacaatagaaagaaataataataaacataaatcgtattaatcaaaatggcaacattacaaaacattaggtcgaaaggacctctattggtgattgttatcggtttggcgctgtttgctttcatcgcgggtgacgcgtggaaggtgatgcaaccgcaccaggcacatgacgtaggtgaggtgaacggagatgctctttccgctcaagagtatcagaatctggtagaagaatataccgaagtgataaaactctcccgtggagtgactgcactgaacgacgaacagaccaatcaggtgcgcgacgaagtatggcgttcctacgttaataacaaactggttgagaaagaagcaaaagcattgggactgacagtttctgctgctgaaattcaggatatcctgaaagcaggcgtgcatccgttgttgcaacagactcctttccgcaacccgcagaccggtgctttcgataaggatatgctcaataagttcctggtagattacgctaaaatgaacgaatctcagatgccggctcagtatgcagaacagtacaacaacatgtacaaatactggtcattcatccagaagacattggttcagagccgcctggcagagaaatatcaggcattggtagcaaaagcgcttctctctaacccggtagaagcacaggacgcttttgacgcaagagtgaatcaatatgacttgttgatggctgccgttccttattcttctatagtagattctacaatcgttgtgaaagaatcggaactgaaagacctttataacaagaaaaaagaacagttcaagcaatatcaggaaagccgtgatatcaagtacattgatgttcaggtgactgcaagtgcggaagacagagctgctatccagcaggaagtagacgaagctactgcacagctggctactacaacagatgactatacttcttttatccgttctgtaggctcggaagctccttatgtagacttgttctataataaaacagctttcccgtcagatgtagttgcccgtctggactctgcatccgttggttctgtttatggtccgtactataatggtgccgacaatactatcaattcattcaaagtggttgcaaaaacagctgctgccgactcaatcgagttccgtcagattcaggtgtttgcagaagacgctttgaagacaaaagccttggcggacagtatctatactgctatcaaaggcggtgctaacttcgcagatctggctaagaaatacggtcagacgggtgagactaactggatgagctctgcacagtatgaaggcgcacagatcgatggtgacaacctgaagtttatctctgctatcaataatacaggcgtgaacgaagtagtaaacctgccgttgggacaagctaatgtaatcctgcaagtgactaacaagaaagctgtgaaggataaatataaagtagctgttgtgaaacgtgaagttgaattcagcaaagaaacttataaccgtgcttacaatgatttcagccagttcatcgctgccaatcctactgctgaaaagatgatcgctaacgctgaagaagccggatacaaactgcttgacagaagagacttgtatagctcagaacatactatcggtggtgtaagaggtactaaagaagcattgagatgggcattttccgctaaaccgggtgatgtttccggtttgtatgaatgtggcgaaagcgaccatatggttgcagtagctctggttggtgttactccggaaggatatcgtccgctgaaagctgtacaggatcagttgagagctgaaatcgttaaagataagaaagccgaaaagatcatggctgacatgaaggctgccaatgcaacttctctcgaccagtacaaggctatgtccggcgcagtcagcgattctttgaagctggttacatttgccgctcccgcttatgtttctgcattgcgcagcagcgaaccgttggtaggtgcttatgcttctgtggctgaaatgaataaactgagcgctccgatcaaaggtaatgccggtgtatttgtgcttcagatgtatggcaaagacaaactgagcgatactttcaacgctaaagatgaagaagctacattggctaacatgcacgcacgcttcgcaagccgtctgatgaacgacctgtatctgaaaggaaaagtgaaggatacacgttacctgttcttctaagattagtcgtaaaaacgataactgcaaaaggtcgttccatgctttggaacgaccttttttgctaacttttacatccttgctatacggaaatcgactttatttccttacatttgcaaatataaaccatgaacagaaagaatgatgtctaaatatcccctcttaggaatgacgcttatagagctgcagtcactggtgaaacgtctgggaatgccgggctttgcagccaaacagattgcatcctggctttatgataagaaggtgacttcgattgatgaaatgactaacttgtcgttgaaataccgggagttactgaagcagaactatgaggtaggagctgaagctccggtggaggaaatgcgctctgtagacggtacggtgaaatacctgtaccctgtgggcgagaatcattttgtggagtcggtgtatattccggatgatgaacgggcgactttatgcatttcttcgcaggtaggctgcaaaatgaactgcaagttctgtatgaccgggaaacaaggctactctgccaacctgaccgcccatcagattatcaatcagattcactccttgcccgaacgggacaaactgacgaatgtcgtcatgatgggaatgggcgaaccgctcgataatctggaagaggtgttgaaggcattggacatactgactgggtcctatggttatgcatggagtccgaagcggattaccgtttcaactgtcggattgcggaaaggattgcggcgctttatcgaagaaagcgactgtcaccttgccatcagcctgcattctccggtgaccgcccagcgtgcggaactgatgccggcggagaaagccttttctatcacggaaatggtggaactgttaaaaaactatgattttagcaaacagcgtcgactttcgtttgagtatattgtttttaaggggcttaatgattcgcaagtttatgccaaggagttactcaaactgcttcgcggactggattgccggatgaacctgatccgtttccattctattccgggagtagcccttgaaggagccgatatggatacaatgacccgtttccgtgactatctgaccacgcacgggcttttcactaccattcgtgcttcgcggggagaggatatttttgcggcatgcggtatgctgtcgactgcgaaacaggaggaaaataataaaagttaatataaaaatcgaacatcatgaaaaagtactttttttatttaagcatggctctggtagccttcgtagttgcttcttgtggattaaaggggaatcatacctctagcggtcgtccgtatgaactgttggttgtagtagatgcgggagtgtgggaccgtgccgccggaagggccttgcatgatgtgcttgattctgacatgccgggactgccccagtcggaaccttctttccggattatgtatacttcaccgaaggactatgattctacgctgaagttgatccgtaatattgtgatagtagatataaaagatatttataccaaaggtactttcaagtatgcgaaagacgtttatgcttctccacagatgatactgaccattcaggctccgaacgaagaagtgtttgagaagtttgtcgaagaaaacaagcagacgattatcgacttcttcactcgcgctgaaatgaaccgtcagattactttgctggaggaaaagcacaacaactttatctcaaataaggtagatagtctgtttggctgcgatatctggataccttccgaactgaataactccaagacaggagaggacttcttctgggcatctaccaatacaggcagcgcggatcgcaatttcgtgatgtattcttatccttatactgacaaggatacattcaccaaagaatactttgttcataagcgcgattctgtgatgaaagccaatatccccggatataaagaaggcgtatatatgtcgacagactcgttactgaccgatgttcgtccgatcaacgtgcacaatgactacacgatggaagctcgtggattgtggcgcatgaagggtgacttcatgggtggcccgttcgtttcccatactcgtctggatcagaagaaccaacgtattattacagcagaaatatttgtatattcacccgataaaatgaaacgcaatctggttcgccagatggaagcatctctttatacgctgaaacttccgcaagaaggtcagcagagtcagattccactgggggtaaccagagaagcggaaccaactaataaataaaaacatggaagaaaacaaaataagaatcggcattacccaaggagatatcaacggggtaggttatgaagtgatcttgaagacattctcagaccctaccatgcttgagctatgtactccgattatctacggttcacctaaagtagcggcttaccatcgtaaagcactggatgtacaggctaatttcagcattgtcaacacagcttccgaagccggatacaaccgtctgagtgtagtgaactgtacagatgacgaagtgaaagtggaattctccaaacccgatcccgaagcaggtaaggctgcattgggtgctttggagcgtgccatagaagagtatcgtgaggggctgatcgacgtcattgtgacagctccgatcaacaaacataccattcagtcggaagagttctctttccccgggcatacggagtatattgaagaacgtctgggcaatggaaacaagtcactgatgatcctgatgaaaaacgattttcgtgtggctttagtaacgacgcatattccggtaagggagattgctacaacaatcaccaaggaactgattcaggaaaagctgatgattttccatcgttgtctgaaacaggatttcggtatcggtgcgccccgtattgcagtgctttcactgaatcctcatgcaggagacggcggactgctgggtatggaagaacaggaaatcattatccctgccatgaaagaaatggaagagaaagggatcatctgttacggtccttatgctgcggacggttttatgggttcgggcaattatactcactttgacggaatccttgctatgtatcatgatcagggactggctccgttcaaagccctggctatggaagacggtgtgaactataccgccggactgccggttgtacgtacctctccggctcatggaacagcctatgacatcgccggtaaaggactggccagcgaagactctttccgtcaggctatttatgtagcgattgatgtattccgcaaccgccagcgcgagaaagcggcacgggtaaacccgttgcggaagcagtattacgagaaacgggacgatagtgataaactaaaactggatacagtagacgaagattaagtaataggtattaagtaataagtattaagtattagccatgcggatggaagcgagatgataatgatggtaatacttaatacttattacttaatacttattacctattacttaatattaagatagatgaccaaagcggagatacaacaagtgaaacagcgtttcggtattattggcaataccgaggctttatcacgtgccatagatgttgccattcaggtagcgcctaccgatttgtctgtgctgattaccggagaaagtggtgtcggaaaagaaagttttccacagatcattcatcaatatagccggagaaagcacggacagtatattgctgtcaactgcggtgccataccggaaggtacgatcgattccgaactgttcggacacgagaaaggagcatttaccggtgctattggtgagcggaaaggatattttggagaagctgacggtggaaccatcttccttgatgaagtgggagagttgccgttgcctacacaggcgcgtctgcttcgtgtacttgaaagcggtgaatttatcaaggtaggttcatccaaagttcaaaagacggatgtgcgtattgtggcagctaccaacgtgaacctgacacaagccattgccgaaggacgttttcgggaagatttgtattatcggttgaacacggtgcctattcagataccacctttgcgtgagcgcggagatgatgtgctgttgttgttccgtaagtttgccgcagactttgccgaaaagtaccggatgccggctatccagctgacggaagatgccaagaagatattgcttgcttatccgtggccgggaaacgtccggcagttgaagaatatcacagagcagatttcgattatagaaacaaaccgtgagataacggctgcgattctgcagacctatcttccggcacagaatacccaacgccttccggcactgttcggcacacgcgagagcaagagctttgagagcgaacgcgaaatactatattctgtcttgttcgatatgcgccaggaagtggcggaactgaagaagatggtgcacaatatgatggccgaacgtgcgggacaagtcggacagatgggacaggtagtggctactccggtagtgacgacgacgcaccaaccatctgtgccggccattatccatgctgtgcagcaaccgtctgtttgtcccaaagaagacgatgacgatattcaggacacggaagaatatgtggaagaaaccctttcgctcgatgaagtggaaaaagaaatgatacgtaaagcgcttgagaggcatcatggtaagcggaaaagtgcggcaaaggatctgaatatctccgagcgtaccctttacagaaaaataaaagaatatgaattggattaagaaaatagcacgaccgctgatactgattgttttaccggcagtcatcatcgcctgtagtgtgtcctataagtttaatggctcctctatcaattacgataaggtgaagaccatttcgattgctgatttcccgattaagtcggagtatgtgtatgctccgctggctaccaagttcaatgaagacctgaaagatatcttcatcagacagacccgtctgcaactgctgaaaccgaaccagaatgcggatctgcagattgacggtgaaattacgggctacaaccagtataaccaggcagtgtctgccgatggttactcttcggaaacgaagctgaccatcacggtcaatgtacgctttgtcaacaacacaaatcacgccgaagacttcgaacaacaattctcagctttccgtacctatgattccagccagctgctgacggccgtacaggatggattaatagcggaaatgagtaaagagataaccgaccaaatatttaatgcaactgtagcaaactggtaatttaatgacttctgttaacttgcaacaatggattcagcatcccgagacgctgaatagggatactttgtacgaactgcgcaaccagctcgcgaggtatccgtattttcagtcgctccggttgttgtatctcaagaacctgtatattctccacgacattaatttcggtgcggaactgcggaaagccgttctgtatattgccgaccgacggaaactgtttcatctgatcgaaggcgaacgcttcgctgtcgaatcccagaagaaagggttgcctctctctgaagtattgaaagatgagcctaccgtcgaccggacactggctctgatcgatgctttcctttcgacggctcccgaagaagtaaccagtcagacaagctttgattactccatggactatacggcataccttctcgaagagacacctgtcgccgacgagccggcagaggcaatgcccaagctgaaaggacacgagctgattgacaactttatcgaaaaaagcgagactgatccagtcgtatacctgaaacctttgagggaagaagagaaagcaaaggcagcttcttccgctgaaacaaacgaaacgggcagaacagacgaaacaactgaaaccaacaccatagaagaggaagatgacagctgtttcacagaaactttggccaaaatctacgtaaaacagcaacgatattcgaaagctcttgaaataattaaaaaattaagcttgaaatatccaaaaaaaaatgcttactttgcagaccaaatcagatttttggagaaattgattattaacgctaattcaaaataactaaaaatgtacttattattcattatcttaatggtgattgcagccttgctgatgtgcttcatcgtgctgattcagaattcaaaaggaggcggacttgcttctggtttttcttcatcaaacgctatcatgggcgtgcgcaagactacagattttctggaaaaagcaacttggggtctggctatcttcatggttgtgatgagcgttgctactgcttacgttgttccttcttcttctgcagctaaagatgtattgttggaacaagcacagaaagaacaacaaaccaacccgtataatatgcctaccggtactgctgctcctcagacagatgctactgctcctgcagagtctgcaccagcaacggaagctccggctactgaaactcctgctcctgtagcagaataattcagtgacaggatattcggtttaaacttattgagtgaacgggctttttgacccgttctcttcattataggcgcgaattacgcgaattacaagagattctaatagaatcgtgtaatacgtgtagttcgcgtctgtctttattattgggcccggtctgctcttcttcatacaggaatatccggtcagatgtcctttttcttataaaatgttctccttttttagtaaaacaaatgataattagttaactttgttgcccgttacgagattattaactccttttaaatattacaatgacagaacaattgaaacaaaagctgaatgactccgcagtgctgcgttggagtgttctagcattagtcgcttttaccatgttgtgcggctacttcctcacagacgttatgtctcctctgaaacccatgcttgaaaaagaacttctctgggacagtttagattacggttttttcaccagtgcttatggctggtttaatgtattcctgctgatgctcatctttggtggtatcattctggataagatgggagtacgcttcaccggaatgggtgcctgtttattgatggtgttcggttgtggattgaaatattatgctattactactactttcccggaaggtgcgatgcttttcggattcaagatgcaagtcacattggctgcattgggttatgctattttcggtgtaggagtcgaaattgcgggtatcaccgtttcgaagattatcgtgaagtggtttaaaggcaaagagatggctctcgctatgggactggaaatggcgaccgcgcgtattggaacaactttggccatggtgcttaccgttcctttggcagacttcttcgggtctacggatgagagcggcgtattccataccaatattcccgctccgattctgttctgtctcgtcatgttgtgcgtaggtaccatcgcattcttcatctatactttctacgataagaaactggatgcttcactggatgcggaagggctggaaccggaagaacctttccgcatgaaagacattgtctatatcattaccaacaaaggattctggctgatcgcattactgtgcgtattgttctattcggctgtattccccttcatcaagtatgcggccgatttgatggtacagaagtacaatgttgatccgaaacttgcgggaacgattcccggattgctgccgattggcgcgatcatcctgacaccattgttcggttcattatatgaccgtatcggtaagggagccacgctgatggtgatcgggtcggtgatgctgattttcgtacacacgatgttcgctcttcctattctgaatatatggtggtttgcaacggtgatcatgattattctgggatttgctttctcattggttccttcggcaatgtggccttcggttccgaagattattccggagaaacagttgggaacggcttatgcgttgatcttttgggtacagaactggggattgatgggcgtgcctttgctgatcggatgggtgttgaactcttattgcaaaggtccggttgtagatggtgcacagacttatgattataccttgccgatggctatttttgctatgttcggtgtacttgccctgattgttgccttgatgctgaaagtggaaaacaagaagaaaggctacggactggaagaagcaaatattcagaaataatcacagtatatattctatctgaaaagatataaaagagaaaagatatggctacgaaagagaaaataaacctcctggaggtgataccttgtcgtaacgaacatattaaagctgaacaggaaggggagactattgtgctctccttccctcgttttaaacgttcgtggatgagtcgttatttattgccgaaaggaatgtccaaagatattcatgtgcgtctggaagaacacggtacggccgtatggaacctgatagacgggcagcggacggttcgtgagattatagaaaaactcgcagaccactttcaatatgaagcaggctacgagtctcgtgtatctacctatctttcccaattacagaaagacggatttattaaatggataattatccattaaaaaagattgcccacaggaggacagcacatcctatcagtacgcccataatgataagcgttccccatacgaaatagctgttatctttttcttttttcttttccgaatccttgatgatgcgttccatctcttccggagtcgtatccggcagaagataagggtcgttgtttcttctaagtcgccctaacttgtcatttctccgttcacggcgtaagcgggaggcttctttgccgtctttcagccgacgtatcatgtcgagcatatgtccttcgccacccatcgttttgtttttttagaggttttatttgctttcttctctatctactttcagtagtccaccggtcaccggatcaaagtaaactttgatggtcgagttcttgttgaataataccggagcaaggtattctatgataccgaactgagtaacaggtatttctccttcatacaatttctttttgccgtccgtcagcgtcaccattgcctgtcccggtacgttataagcaatgccttccatctctttcttcttttttccgtcctcttgcggaatcttcaccgttttcaggtctttcagactgatgtagaatggagtgcctgccaaatcgttgttggcaactatacccagcttctttgaaaagcggaaagctacctcattgtcgaattccttatccggagtgaggcggacagtaaatgtcttttcttctttattgcggactcccgaaaacatctcggtcatggcttcttcctgaagattcaggttgtcgagcatgattttgagctgtgcgccgtccgaaggcatattatctgcttgtccgcgcaataatgcgtttttactttcgcggatattatagatttcctttgctaccagttcggccatcttggcggttgaacttgccatcagaatttcttctgtgagaaagtcgcggggattggcttttcgttggggagcaacggcattgtttgctgcattctttgcattgttactgctgtaggggacgttgattgatttgataagaccctcttcagtcagttccataagaggagctacggttttgtctttcagtttgacgaaataagtagcttcgctgtttggtacacctacaggtttcactttgacactgttcagttcccagtattcttcgggttcggcagagacgttggtcagtctcaggtagcggtcggcgtatttgctgaattcacccggcttatagttgactttgtttgcttttatttctatttctatctgggttttggggagggcgtacactactccgtagtcttttcctcgcgtcactcctgtcagcacttcggtctgcgcataggcggaagttgccattagtagtcctgttgctatgattaactttttcatattcggttctttttagctgattttgaaaaacaaagttaatgaagttattgaataaaccgtaagttcttaacttttattcgcttacaagtcgccatgccgtcggcagacaagtcacgatatcacttgcgattaatccgatcatgccctgttttttctgggcgatgtctccggccaatccgtgaatgtaagtaccgatctttgcggcgtcttcggcgggatagccttgcgcaaggagtgcaaggattactcctgtcagtacatctccgctgcctcctgttgccataccgggattaccggtctggttgaagtaacatttgccttcgggggtgataatggcggaataagctcccttcagaatgatatgtactttggcagtgtgcgccagttcgcaggctttcatcagtcgttcgtatgagtcctgacatttgccgaccaggcgttccagctctttcgggtgaggggtgaggatggaacctttcggcagatgggtgagcgtatgccggtgattggccagaatattgagtgcgtcggcatccagtaccgtcggagtctgacaatgttccagttgttctatcagggcggcttccgtttcctcgttgcgaccgagtcccggaccgatgccgacagcttggtaatcgtccgtatcggtaggtacggcaaagcatgtttcgctgacatctgtttctaccatggcttcgggggcggacgtttgcagaatatcgttgttgcataacggcgcgtgtaccgtcagcagacctactcccgatcgcagacaggcacgggcggccagtaccgatgcacctgccattccttttgagccggctatcagcagggcatgtccgaagtttcctttatgggcgaattgttggcgtggtttgatcagtgaacggatttcttcgatttccagcatttcgtagtttgtttcagtctcttcgattccttcttcgctcagctggatgtccaataactcccattcgccaacgaattctgtattttcggcgaagaggaatgccagtttaggaagttgcagactgaaagtgacgtccgcacggataatattgctttttacattgaatgtattttcttctcccatcagtccggaaggaatgtcgatggagactaccatggcgggagaggcattgatatatttcacgacggcagcgaatcctccgctcaatggtttgttgagtccggaaccgaataatccgtcgatcacgagatgctccggtgtcagtgtgggaggtacgaactgggtgctgatttcatggaaagttacttcttccatcatctctaccagttctttgttggtctgacagtcgggcgaaagttcgcctttcgtgttgaagagatatacttcgatcttgtatcctttttccgccatcatgcgggcgacggcgagggcgtctccaccgttattgcccggtccggcaaagatggtaacaggtgtttccggattccatctgttggtgatggctttagtcagcgcctgtgcggcacgttccattaaatctatggatgcaatcggttcatgttcaatggtataagcatctaacttcttaatgctgctgcttggaaatattttcattgcgatattcttttagttttcgacgcacaaacttacacaaaaactctgaattaatcctttattccggttggttttcggctttagataaagtggcaaattgaaaaatgcaggggaaatcagaagttatcttggggtggctttgtcctgtctgtctgtgattcctcagttggggggcggatatttctctgctaaggtacgggcattcttcagataagatgcggagactcttcggctaagatgcaggtattcttctcttaaagtgcctttctctttagttgctcacggccgtgacaagacctcgccacgaccgtgagcaatgctaatcacggtcgtgaacaatgcttgtcacggccgtggtcagttaatgatatcggtgctttgatgtaactattcttctgctttcttcttaatcttccgatactttgagagatagttacgccttctccggcctgctatagaactgcttcctttatgagtgtcttcggtgtttggaataaagctgttagtagatatggtacaatataaacagctaatgtcttgattatttgcttttttcgaaaaaaatgatatctttgtagtgcagtaatgtgctttacgttattctcctgtgctcacaatgtttagattataaatataaattgtttaatcttctaaagtttgcatgatggaaaagaaaagaattggctcaaatgccgggaaagtatggcgcatcttaaatgaaaagggcgaacagtctatgttcactttgtgccatgagttaggtttgacgttcgaggatgtagcgattgctatcggctggttggcaagggaaaacaaaatcctgcttagaaaaaaagaaggaatgctctatgccagtattgagaatgttgaatttacttttggataaatggcgactgacccacatttaaggagaatatccacttgattatttacactgttgaaaacttaataaggtgggtaactgagacttcttgcatgccatcctgtatttttctattccataagaatcttcttttttgaggcatttaatctactttttagtacctttgcaccccataaactactaaacacataatttcatgagttcattgaaagggcatccgaaaggcctttacctaattttcgcaacgagcacggcagaacgtttcagttactacggtatgcgtgccatctttatcctctttctgacgcaggcattgctttttgataaagaagcggcagcctctatctacggtagctataccggactggtctatctgactccgttgatcggcggatacattgccgataaatattggggcatccgtcgttcggtgttttggggagcggtgatgatggcagtcggtcagttcctgatgtttatgagtgcctcttcactgaacaatacagaccttgcccactggctgatgtatggcggactcggattcatgattttaggtaacggttgctttaagcctaccgtttcttcgctcgtcgggcaattatatgaacccggggacaaacggttggatgctgcatacaccattttctatatgggtgttaatgtaggttctttcgctgctcctttgatttgcggtttcttgggagacacagggaatccgcaggactttaaatggggattcctcgcatccggaatcatgacgctgttcactgttgtcctctttgaaactcagaagaataaataccttttctctccttccggtgaaccaattggtatcgtccccgacgccagacgtgaaaaaaaggaggataaagccgaacatatttcacatccgaagatggacaaacgtaccaaagtacgtaatatcatcatcattactgcccttacagttgccttaatagctttttttagctatgcctttagcgatgactggattagtgtgggtatctttacggcttgtattgtctttccagtactcattctgctggatggttcattgaccaaagtagaacgtagccgtattttcgtaatctatatcgtagctttcttcgtcattttcttctgggcagcttacgagcaggcaggagcttctctgacattattcgcttccgaacagactgaccgcagcattttcggctgggagatgccggcttcgtggttccagtcattcaatccgctttttgtagtgatccttgcctatattatgcccggtatatggggctttctgaataagcgaaacatggaaccggcttcccctaccaaacaggcaatcggtctgttgctgctttctcttggttatctcttcatctgttttggagtgaaagatgctattccaggagtaaaggtgagcatgatctggctgacaggactttattttattcatacaatgggagaaatcgctctgtcacctatcgggctttctatggttaataagttgagtccgttacgtttcgcctccttgatgatggggatctggtatctttctaccgccaccgcaaataaatttgcaggtatgctgagtggcctctatcccgaagacggaaaagtgaaatcaatccttggttatcagatcgctaccatgtatgacttcttcatgctgttcgtcattatgtccggtgttgcctcactgattctgttccttctctcgaagaaattacagaagatgatgcacggggtagaataaaaaattgtatttttgcgacaacttttttaaaatgaccggttatggataccatacagataaaagacaagcaatttactgtttccattaaggaacaggatattcaaaaagaagtgattcgcgtagcgaacgaaatcaatcgtgatttggcaggtaagaatccgctcttcctcagtgtgttgaacggctcgttcatgtttaccgccgacttgctgaagcatatcacgattccgtgcgaaatttcatttgtgaagttggcatcttatcagggggtgacttccaccggagtaattaaagaagtgatcgggctgaatgaagacattgccggacgtacggtagtgatcgtagaagatattgtagataccggactgacgatgcagcgtctgctggatacactgggcacacgcaatcccgaagcgattcatatcgcctctttgctggtgaaaccggaaaagctgaaggtcaatctgaacatagaatacgtagcgatggaaatcccgaatgattttatcgttggctacggattggattatgatggtttcggacgcaattatcccgatatttatactgtagtagattaaattcaaatacaaattaatttataggttaaaaagatgttgaacattgtaattttcggtgctccgggttcaggaaaaggaacgcagagcgaacgtattgtagaaaagtatggaatcaaccacatctcgacaggagatgtattgcgtgcagaaatcaagaacggcacggagctgggcaaaactgctaaaggttacatcgaccagggtcagttgattccggatgaattaatgattgatattctggcaagcgtattcgatagcttcaaagacagcaaaggtgtaattttcgacggtttcccaagaacaattgcacaggcggaagcattaaagaaaatgttggcggaaagaggacaggatgtttctgtaatgttggatctcgaagttccggaagatgaactgatggtgcgtctgatcaaacgtggcaaagactccggtcgtgctgatgacaacgaagaaacaatcaaaaaacgtctgcatgtatatcattcacagacatctccgctgatcgactggtacaagaacgaaaagaaataccagcacatcaacggtctgggtactatggatggtatcttcgctgatatctgcgaagcggtagacaaattataataaataaaaaatatggctgaatcgaattttgttgattacgtaaagatatactgtcgctcaggcaagggcggaagaggctctacgcacatgaggcgcgagaaatattgtcctaacggaggtcccgatgggggcgatggtggaagaggaggccatattatcttgcgcggtaaccgtaattactggacattgcttcacttgaagtatgaccgtcacgcgatggcaggtcatggcgaatcgggcagcaagaaccgtagtttcgggaaagacggtgcggataaagtgatcgaagtaccctgcggaacggtagtgtataacgccgaaaccggagaatacctttgcgatgtgacggacgacggacaggaagtgatcttgttgaaaggcggtcgtggcggtcagggcaacagtcatttcaagacggctacccgtcaggctccgcgctttgcgcagccgggcgaaccgatgcaggaaatgacggtgatcatggagctgaagctgttggcagatgtaggactggtaggtttcccgaatgcgggaaagtctacgttgctttctgccatttcggctgcgaaaccgaagattgccgattacccgtttacgacactcgaaccgaatctgggaattgtttcctatcgcgatggaaagtcattcgtgatggcggacataccgggtatcatcgagggagccagtcagggaaaaggattgggactgcggtttctgcgtcatatcgagcgtaactcgttgctgttgttcatggttccggcggatagcgatgatatccgcaaggagtatgaagtattgctgaatgagttgcgtacgttcaatcccgaaatgctggacaaacaacgtgtgctggctatcacgaagagcgatatgctcgatcaggagctgatggacgagattgaaccgacattgcccgagggtgttccgcatatattcatttcttctgtttccggtttgggaatctcagtgttgaaagacattctgtgggaggaactgaacaaggaaagtaataagatagaagacattgttcaccgtccgaaagacgtgacccgtttgcagcaggaactcaaagatatgggcgaggatgaagaactcgactatgaatatgaggaagacgctgacgacgaagacgatgatctcgactatgaatacgaagaagaggattgggaggaaaaatgatttcaatcacaaaagataaaagaatgttggggtatgagtcgttaagctcatactccaacatttctcattttgtaactacccggcagggagggtgcagcgagggaaattatgcgtcattcaactgtacgccttacagtggcgacgaggcagaaaaggtccggcggaatcagacgcttctgatggaaggaatgtcgcagatacccgaagaactggtgattcctgtgcagacccatgagacgaattacctgctgatcggcgatgcttatttatcggcttcgtctcaacaacgacaggagatgctgcacggagtggacgctttgattacccgcgagccgggatattgtctttgtatttctactgcggattgtgtgcccgtgttggtatatgataagaaacatggtgccatagccgccattcatgccggatggagagggacggtagcgtacatcgtacgtgatactttgttgcggatggaaaaagagtttggcacaagtggagaagatgtggtggcctgtatcggtccgagtatctcattggcttcttttgaagtgggtgaggaagtgtacgaagcatttcagaagaatggttttgatatgccccgtatttctatcaggaaagaggaaaccggaaaacatcatatcgacttgtgggaagcgaaccgaatgcaaatccttgctttcggtgtgccgtccggacaggtggagcttgcccggatatgtacgtatattcatcacgacgagtttttctcggcaaggcgtttgggcattaagtccggacggattctgtcggggatcatgattcataaataatagctttgaacatagattgacataaataagcgcataggttggaatagacttgaacgtaagttgatataaacttgaataaaagtatgtttgaaataaaagtatctcaggaaataaagaatgcctgtccggtttttgccggagcagccgtatatgcagcagtgaagaatactgcttactgcgatggactttggaaagaaataaatactttcacagaagacttgactactaccacccaaatggcagacattaagttgcaacctgtgattgctgctacccgtgaggcttataagcgttgtggcaaagacccgggacgttatcgtccgtcggcagaagcgctgcgccgtcgcctgatgcgtggcatccctttgtatcagattgatactttggttgaccttatcaatctggtttctctccgtaccggacattctatcggtggcttcgatgcggataagatacagggtaaccatcttgaacttggcattggcaaagcggaagaacctttcgaaggtatcggccggggcattttgaacattgaaggattgccagtgtacagagattcttttggaggaatcggaacaccgaccagtgaccacgaacgtacgaagatggatatcgggactactcatattctcgcgatagtcaacgggtataacggaaaagagggactaaaggaagctgctgaaatgattcaatccttactgaaggattatgccggatcggatggcggtgaacttatctattttgaataacaaagaaagaaatacatgaagaacatacttattttattgacagtcctgcttttaccaactcttgcttatgcgcaaagtaaatcctctttttcttctatggaggtgaatcacgtacgggttgctactcccggactttttgcgaaaagtaatcatatatatctgcatttggattctttgcaagagcatgaatatgcttttcccttaccgggagccaaagttatttccgcttacggaactcgcggaggacattcgggagcagatataaagacgtgtgccaaagatacgattcgtgctgcttttgatggagtcgtacgtatgtcgaagccatattatgcttacggaaatttggttgtagtccgtcatgcgaacgggctggaaacgatttacagtcataacttcaagaatttggtacagagcggagatacggtgaaagccggacaacctatcggactgaccggacgtaccggccgtgctactacggagcatgtgcattttgaaacccgcattaacggtcagcattttaatccgaatcttattttcaatctgaaggagggcacattacgaaaggaatgtattaaatgtacgaagaatggaaatggggtagtggtgaagccacaggcgaataataatcgtgtggcacaaaataaaaagtgaaagaactgagatggtctgaaaaagacggaaggggattgactaaaaagacaatagtatctccccttcccttcgggaaggaggggtggctgaaagccggggtggtaggtaaaatagggttgtctataatttgcagtgaataagtggactgcgtattcacctaccacctccccctgcgggtactcctccttcccgaagctaccctttatacacaagtcttagctgattaactcatacagttcaaactgtgtataaaatctatccagtccattcttaaaggtaatatatcctggaatggactggctcttgtatgcactccatctgtatatgaggcgataaggcaagaataaatattaacatataaaaaagtaagcaaaaacatgaatgagaaacaagcggatacactgctgaatgtaccggaaatcgtaaagcgggcgaaaatagcgttgaatctgaaacgggatagtgaacttgcatcctatttaggagtagccagagcgacactttccaactggtgcgcgcgaaacagcatagactttcctttactgctgaataagctgcgtcatgtggactacaactggctgctgaccggaaagggaagtccgctgcacgacccaaagtcttttgacaacggaaagatacggggagaagtagagactattcacaattcaaaaaccacagaagccatagacgaccgaagtgtgacgctctatgacatcacagccgccgccaatttaaggaccctgctttccgacaaacgccaatatgcgctgggcaaaatactgattccgagcatacccgcgtgtgacggagccatctttgtcaacggagacagtatgtatcccattctcaaatcgggagatatcgtagggttcaaggggatcaacaacttcagcaacgtcatttacggagaaatgtacatcgtggcgttccacctcgacggagaccagtatctgacggtgaaatacgtcaaccgctcggagaaggaagggtacgtcaaactcgtcagctacaatccgcaccacgagccgatggacttgcctgtagacaccattcaggatatggcaatagtgaagttctccatcagaaagaatatgatgatgtaaaaacggcacaggctaaacaagccttttccacagatttcctgtcacatttcttcctgaaatctgtggaaagcattatctttgcacgttgcaaaccgtatctttgcacattgcaagcagtaaaatcataaaatcactctatatcaatggaaaagaaattcaagagaaccaccgtcacatcggcactgccgtatgcgaacggacctgtacacatcggtcacctggccggcgtatatgtaccggcagatatctatgtgcgctatctgcgactgaagaaagaagatgtattgtttatcggaggttcggacgaacacggagtacctatcacgattcgtgcaaagaaagaaggagtcactccgcaggatgtagtagaccgttaccactatctgatcaagaaatcgttcgaagaattcggcgtttcgttcgatgtatacagccgcaccacttcgaagacgcatcatgagctggcttcggatttctttaagacgctatacaacaaaggagagtttatcgaaaaaacatccgaacaatattacgacgaagaagcgaaaacattcctcgccgaccgctacatcaccggtgagtgtcctcactgccattcggaaggtgcctatggcgaccaatgcgagaaatgcggaacctccctgtcgcccaccgatctgatcaacccgaagagcgccatcagcggcagcaaacctgtgatgaaggagaccaagcactggtatcttcccctcgacaaacacgaaggatggttgcgccaatggattctggaagaccacaaggaatggcgccccaacgtatacggacagtgcaagagctggctcgacatgggattgcagccgcgtgccgtcagccgtgacctcgactggggtatccctgtgcccgtagaaggtgcggaaggaaaggtgctgtacgtgtggttcgatgctcctatcggatacatttccaataccaaggaattgcttcccgacagttgggagacatggtggaaagaccccgaaacgcgtctgctccacttcatcggaaaggacaatatcgtattccactgcatcgtattccccgccatgctgaaagcggaaggaagctatatcctgccggacaacgtgccgagcaacgaattcctgaatctggaaggagacaagatttcgacttcccgcaactgggcggtatggctgcacgaatatctggaagacttccccggcaaacaggacgtactccgctacgtactgaccgccaatgctccggaaacgaaggacaacgacttcacatggaaagacttccaggcacgcaacaacaatgagctggtagccgtatacggcaacttcgtgaaccgtgcaatggtgttgactcagaaatacttcgacagcaaagtacccgcctgcgcagaactgacggattacgacaaagaaaccctgaaagaatttgccaacgtaaaggcagaagtagaaaagctgctcgacgtattcaaattccgcgacgcgcagaaagaggcgatgaacctggcacgcatcggcaacaaataccttgccgacaccgaaccctggaaactggcaaagaccgacatggaacgtgtaggcaccatcctgaacatctctctgcaactggttgccaaccttgccatcgctttcgaaccgttcctgcctttcagctcggagaaactccgcaagatgctgaacatggaaagcttcgaatggtcggaactgggaaggaacgacctgctcccggtaggacatcagctgaacaagccggaactgctgttcgaaaaaatagaagacagcgtaatcgaggcacaggtacagaagttgctcgacacgaagaaggccaacgaagaagccaactataaggcaaacccgattcgtccgaacatcgaatttgatgatttcacgaaactcgacatccgtgttggtaccatccttgaatgtcagaaagtgccgaaagccgacaagctgctgcaattcaagattgacgacggactggaaacacgtactatcgtatcgggcatcgcaaagcactaccagccggaagaactggtaggcaaacaggtttgctttatcgccaatctcgcaccgcgcaagctgaaaggtatcgtcagcgaaggtatgattctgagtgccgaaaacaacgacggtagcctggcagttatcatgcctcagaaagaggtgaagccgggcagcgaagtgaaataagcaataagctaataagccatcaacaaatgaggaatggaaggatggggtgtcaaaatagtaactaaactctcctccttcgggaaggaggagtacccgcagggggaggtggtaggtgaatacatcaactgatgatattcacttgtgcagtacacctaccaccccggctttcagccacccctccttcctgaaggaggggaatttagttactactgacttttgacacactctccttcaccgattataataatatgagtgaagaacagtcactgaaacaaaaaacagcaaaagggctattttggggaggcctcagcagcagtgtacaacagctgttaggacttcttttcggagtagtgttaggaagattactggaccctgccgattacggtatgatcggtatgctggctatctttccggccattgcttccgccctgcaggaaagcggatttgtcgcagcactcgccaatcgcgagaaagtcagcgataaagactataacgctgtattctggttcagtatctcttttagtgctgttctttatattttgctctattcttcagctccgctgattgctaaattttacgatactccggagttaacgtcgctcgcccgtttctctttcctcagtttctttatagccagtttcgggatagctccgcgagctcttctcttccgtaatctcaaagtgaaggagaataccatcatttctctttcaagcctgtttctatccggtattgtggggattattcttgccgcaaacggatttgcctattggggtctggctatacagacaatgacctttgtcgtcataggcacggcactcaactggtactttgcccactggaaacccagtttccgcattgacttctctcccatcagggagatgttcggattcagcagtaaaatgctgattacgcaagtctttattattatcaaccaaaacctgttctccgtcctgctgggtaaattctacactaaacaggaagtcggagacttcagccaggccaacaactggaacaataagggacacgccctcatcaccggaatgatcaacggagtcacccagcccgtactggcaagtgtagctaatgacccgcagcgtcaggcggccgtgtttcataaaatgctgcgtttcacggcttttatttctttccctgccatgttcgggctcagcctcatttccagagagtttattctgattgccatcacggacaagtggctcgcttccgcacggatcatgcaattactttgtatatggggagcctttattccgatcaacaatctgttctctttattgctggtcagccgcggacggtcttccatctttatgttcaacagtatcgcactgagcgtgttgcagctgatcactgcctgtatcagttatccatacggcatcaccaccatgatttatctgtttgtcgctatcaatatactttggctgtttgtctggtactgctttgcccggagggagattccgctgacgctgttcagcatactgaaagatatcgctccttattttctactggcagcttcgctgacaatcgcagcccattacataacgtcgggcatcactaacctgtatctgtcacttgccatcaaagtagttttcgtggcttctctatatgcacttgttttgtggaaaatgcaatcagtcattttcaaggagtgtattcagttcattaaaaagaaaaagatatcatgacgacacctaccaattacatagcgacctggttctacaaggaatccaaagaagatgccagtttctatccgcaggcaggcaaacggggagattccgccctcgtccattccatttatatgcagatacaagtgccgttctttaccactttcaggcattatcatcccaatgataagttgcttttcttcagcaatctggatcagtttcccgattatctggaacggttattcaaggagttacggattgagactgttaccctgccttatctctgcatccctcccaaaggatggtacggggcatggagaaatcaattctatctgtatgatatcctgcgctatatggagaaaaggatgcaggcggacgatacgttgctcatctgcgatgcggactgtctctgtatgcgtccgttggggcaactattcagcgacacacggaaatacggttccgccctgtacgatgcatccgaccgaccggacctcaaagtgaacggaatcacactaaaggagatgacagatatctataatgactgttacggagaaaaagagaagagagaaaaagagaaggaggcaacgaagaaaacagaagcggaaaaggaagaagcagagcagcaagatacgaaaaacggagtcacaagaacagagcttgtccattattacgggggagaatttatctcgctgcgtggtgatgtagtggcacgaatcaacgaagcgtatcctgctttatggaattataatctggaacgttttgccgccaatcagcccaaactgaacgaagaagcccacttcctgagcgtagtggctacgaggctcaacatccacaacaatatcgccaatcaatacgtcaaacgcctctggacctaccccaaatacaatacggtagaaaaaggagacgagcaactggcggtatggcatcttccctacgagaagaaaagaggattgtatctgctgtacaaacactttgtgaaccaccccactttcgacgatgaagaggccttccgcaagaaagcctccgcctacaccggtgtgccgaccgttactttcggcaaacgcatccgcgatttcatcaccattctttctctaaaaataaaagacaaatgcatatactgatacttccaatgtactatcctgagaaggactcctccccgcaccggggatatatgttcttcgagcaggctatgcaactggctaaatcaggctgcaaggtaggacttgccttcacggagcaaagacctctgaagaacttcacatggaaacggttccgcaaagagagtcattttcagatatcggcagaagataacggcagtttcgtcaccatgcgcctgcacgcatggaacccgaaactaagcacccgcgcgggaggaatcatctggtctctgctgaccgtcttgttagtacggaagtatatccgcacttacggtcgccccgacctgattcatgcgcacttcggcacatgggcagggtatgccgcccgactggtttataaatggtataaggttccctatgtcatcacagagcacgcctcttccatcaacggcaatcagacgacaccgtcacaggcagtgatactgaagaaggcatacagcgaggcacgcaagatcatctgtgtcggcacgaaactgaaacggagcctgtgcgcatacgtcagtgacccggataaagtgaccgtcataccgaactttgtagatacgaacacctttgcattcagtcctcaccggacagagaaaaagaaacattttactttcatcagcatcggaaacctgaataagcgcaaaggattctgggatttgctgactgcttttcactgggcattcaaggatatgccgcacgtctctttgatcattgctggagacggggaagaaatgcagccactcaaaaagttaattcagtctctccacctgcaagagcaggtaaaactgaccggccgcctgtcacgggaagaattgtccgggttgctgggtacttgcgatgcttttgtactggcctcctttgcggagacattcggcatcgtattcatcgaagcaatggcaacaggcttgcccgccatcggcaccatatgcggaggaccggaggacatcatcactcccgaaagcggcttcctcatccgaccgggagatgtggatgcgctcgccgctaagatgaaaacattgtacgatacctacgagtcgttcgacaaagagaaaatccgccagtccatcgtcagccgtttcgactttcagttggcagggcagaagttacggcaagtttattcagaagcattagaaatgtccaagcccccaaaagcatcggaatcatgaaagttacagtcatagattgttcagtatcaggccatcgggaaacgtattataaacagtttgctcagacatgggcgggcatggggtacgaaacgtcgctcatcgctcccgacgggaaaggcatacaggaggccgttgcctttcagcctgtctcagcgcttccgctactgccgcttcctgccggaaaaccgttgcagaaaaagctggttgtactgcgcaatgcagtgattcgactgcgaaatctgtacaggctgcgccggagtcttcaacggctgaatcccgatctggtcttctttgcctgcctcgacgatatgctgcctacattggctcccttatggctgttcaatcttttgctgccctatcagtggagcggcctgctggttcagtccgccctgccgccttaccaccgagggatgcccgacacccgccctttcctgcgaagcaagaactgcgtaggagtaggcatactgaacgaatattcagcgaaaggcctggaaacatttcagcgccacattctgctgtttcccgactttgccgatctttcggctcccgccacaaactacccgttgctgcgcaaactgaaggagagagccagaggaaggaaggtgatatccctgctcggttccatcaatttccgcaaggggataaagttactgttagagagtatccctttattgccaaaggatgaatatttcttcctcattgcggggaaatcatctctcaccgcacaacaggaaaacgacctgcgggcgttcggggagtcaaggaataactgtctgttctcattggagaagattcccgatgaaagctgtttcaatgccctgatagcggagagcgaccttatttttgccgcatacaagcagttcaccggcagcagcaacctcctgaccaaagctgccgccttccgcaaaccggtcatagtcagccgcggcctctgcatgggccggagggtagagcagtacggaacaggccaaaccaccggagaagacaacgccggagaatgcagcgcagctatccgctcgctgtgtaccgaaacaaggatggacactcaggctttcgcccggtacgcccacgaacacgaagtggagaaactaatcacatgttttaatcaaatcagcaagcatatacaatgaaagtactttttacattcggaggaatcccccactacctgaatgccatgctcaacaggctacaggcaaaaggagtagaaataaccgttgtcagcccgaagaaagggaatacgaccatcggcaaaggggtgaaaatggtagaaggaggaacctacaagcatctgaccacaccggagaaaaagatgttctacggaaaaagcgctttccccgcccttcccgaaatcattgcggaagaaaaaccggatatagtggtagtgggatggccctacttcctgcaagtattctttcagcccgcactgagaaaggctatgaagtcctgcaacgccaagctggtgattcgtgaaatccccttccagactcctccctacggaaagatcaaggaatatttcaaagccaatccgatgcacgacgaaggtatgcgcctgctcagcaagggtatcggcttctatctgcgccaatggataacggcaaggatacggaaatactgctacgcccaagccgccggaacgctgaactactcgacagccgcctacgacatcctcccctcttacggagtaaagaaggagcagatacacgtcacctacaactcgaccgatacggaagcacttctcaaagaaaaagaatccgtactggcttccccctccatccttcccccgtgcgaccgtcgcctgctgcacatcggacggctcgtaaaatggaaacgggtagatttattgatagaggctttccggaaggtagccaccgactatccggaagcggaactggtgatcgtaggagacggaccggaactggacaacctcagacaacaggcaaacgacctgcaactggcagacagcatccgctttatcggagccgtctatgacccgaagacactgggcgcctatatgaacgaatcgagtatctatgtgcttgccggcatgggagggctttcgatcaatgatgccatgacgtatggtatgcccgtcctttgtgccgtatgcgacagtacggaacgcgacctggtcatggaaggcaagaacggctatttcttcaaggacggagacgccgatagcctggcaggtagaatcagagagatgttcgaatctcccgaacgctgcaaggagatgggaaaagaatcggaacggatgatccgggaaaagatcaatatggagacggtcagcgaacgctacctgaaggcttttcaagagattcttcgtctcactcatcttcgcgattccggtaattagccggtgaagtccccaaatgcatctttacgtacttcccgaaaaaggactggttggggaagttgaactcttccgctatttccttgacggacttgtccgaacgtttcagccggtacttgatatgttctatcgtcgtttcattgatcaagtccagcggagtcctgccacacgcttgcttgatgactttcgaaaaatgcttcggagtgtagcagagcgcatccgcataataactcacagaacggtgcatacccttgtctttcgataatagctccacgaatttccgcagggtataatccgcctgtttgatgccttctttcggactgtcccccttgtcgggagcatcgatttccttgtgaagctgtcccagcatctcacaaaaaagggcggagaagagatgctgcatcacttccctgtgataataatgaggttcatcattgatcttcgccacaatcaaatcccgataaaacctgaaaacaggatcatccccgccttcgctgatagacttcaccggattgttgtggatatgagcagcggtattccacgttttcttctccattttaataatgcgttgcagaaaacgggtagagaatcccgccagccttatcttatatttaggactcagcatcgtacgactgatcagtgtattgggaagaccgagcagcaagtcgcccgcctgcaactgatacgtccggtagttgatatccagctggatacacccttctgcacagacagcaataaggaaacagttcagccggactgtatcattactatacggaatcccgtccagactgttgactatcgcaaagtcatcgtctatataatcaaggatatgctgactcttcttaaagtcttctatatctactgtcataatgttctctttttccataatctctccttttttactttttgcaaagttggtaaataatagggaaaacagaatgtcccaaactcctttataattgtttgatatatcgtttatacgcaaatagttagccacaaaaagcacaaataacgaaaacaggacattcatagagaaaaatcggtcaccattgacttgttcttttctcctacttttgttctgattttaataaaagacaaaaagagtaagtatgattacagtgaacaaaaaatggatacggctgatagggattgtcggttgtacagtgtggatggcatcgtgcaagcaggcaccggatgcaggagtgaaatcttcttatgcagtcatgcagatagaaccaacggacaaagaactttcttcctcctattcggcgaccatacgcgggcgacaggatattgatatctatccgcaggtgtcgggaacaatcgagaaactctgcgtgaccgaaggtcagaaagtacgccggggacagttgcttttcatcatcgaccaggtaccttacagggccgcgctcaaaaccgccaccgccaatgtggaagcggcacgcgctgctacgagcaccgccgaactgacttacaagagcaacaaggaactgtatgcacagaaagtcgtttcagaatttagcctgaagactgccgaaaactcttatctcaccgccaaggcacaactggcacaggctgaagctcaggaaataagcgcacgcaacaacctctcttataccgaagtgaaaagtcccagtgacggagttgtaggcgcattgccctatcgtgcaggcgcattggtaagcgccaacattccttatccgctcactacggtcagtgacaattcggatatgtacgtctatttctcgatgaccgaaaaccaactgctcgcccttacccgacagtacggcgacatggacgaagcgttaaagaatatgccggaagtggaactgattctgaacgacaactcagtctatcagaagaaaggtaccatcgaatccatcagtggagtgatcgaccgtcagacagggaccgtagtggcacgcgtagtgttccccaacgaatcacggctgcttcatagcggagcatcgggcacggtagtagtgccgagcatctacaagaactgcatcgctatcccccaaacagccaccgtgcggatgcaggacaagacgattgtatataaggtagtggatggcaaagcagtctccaccctgatcaccgtagccggaatcaacgacggacgcgaatatgtagtgctggacggcctgaaagccggtgacgaaattgtatcggaaggcgccggactggtgcgcgaaggcacacaggttaaataagaaggagactgattatgaaaggaaatatatttatcaaacggccggtgatggctatctccatctccgtgctgattctcgccatagggcttatctcgctcttcaccctgccggtggagcaatatcccgacatcgcgcctcccacggtctatgtatccgccagctatacgggcgccgatgccgaagctgtgatgaacagcgtcatcatgccgctggaagagagcatcaacggggtggaagacatgatgtatatcacgtccagcgcctccaatgcaggtctggctatcatacaggtttacttcaagcaaggcaccgaccccgacatggcggctgtcaacgtacagaaccgtgtagccaaagcacagggactgctgcccgccgaagtaacgaaagtcggcgtaagcacgatgaaacgccagaccagcttcctgcaaatcggcgcgctggtctgcaccgacggtcgctacgaccagaccttccttgccaattatctggacatcaacgtcatcccgcagatcaagcgtatcgagggagtaggagacgtcatggagctgggcgatacctacagtatgcgtatctggctgaaaccggaacggatggcacaatacgggctggtgccttcggacatcaccggcgtgctgggcgagcagaacattgaagcccctaccggctcactgggcgagagttcgcagaacgtcttccagttcacgatgaaatatcgcggaagactgaagagcgtggaagagtttcagaacaccgttgtccgctctcgtgaagacggctcgatactccgtctgaaagatgtggcggatgtggaactgggcactatgacttatagtttccgcagtgagatggacagccagcctgccgtgctctatatgatcttccagacagcgggttccaatgcgaccgctgtcaataaagaaattaccgcccagatggagcggatggagaaaaaccttccggaaggaacggagttcgtcaccatgatgagttcgaacgacttcctcttcgcttccatacacaacgtggtggaaacactgattatcgccatcattctggtcatcctcgtggtatacttcttcttgcaggacctgaaaagtacactcatcccgtctatctccatcatcgtgtcactggtaggtacgtttgcctgtctggtagctgcgggattcagtctgaacatcctgaccctgtttgccctggtgcttgccatcggtacggtggtggatgatgccattgtagtagtagaagcggtgcagtccaagtttgatgccggatacaagtcgccctaccttgccaccaaagatgcgatgggcgacgtgacgatggctatcgtctcctgtacctgtgtcttcatggccgtatttatccccgtcaccttcatgggaggtacttcgggcgtgttctatacccaattcggtatcacgatggcaactgccgtaggtatctccatgatctcggctctgaccctgtgtcccgccctgtgcgccatcatgatgcgtccgtcggacggaaccaagagcgccaagagtatcaacggacgggtacgcgcagcttacaacgcttcgttcaatgccgtgctgggcaagtataagaaaggggtgatgtacttcatccgccatcgctggatggtatggacttcactggctgctaccatcgtcctgctggtttatctgatgagcacgaccaagacgggactcgtgccgcaggaagaccagggcgttatcatggtgaatgtcagcatctcaccgggaagcacgctcgaagagacaacgaaagtaatggaccggctggaaaacattctgaaagatacgcccgaaatagaacactacgcccgcgtagcaggatacggtctgatctccggtcagggaacttcttacggtacgatcattgtccgcctgaaagactggagcgaacgaaaaggaaaggaacacggttcggatgccgtagcttcccgcctcaacgcacaattccagtccatcaaggaagcgcagatattcagtttccagcccgccatgattccgggatacggtatgggtaactccctcgaactgaaccttcaggatatgacaggcggtgatcttgctacgttctatgacgcgtccacacagttcctcaatgccttgaaccagcgcccggaagtggctatggcttatacatcctacgccatcaacttcccgcagctctcggtagaagtggatgccgccaaatgtaagcgtgcaggaatttcgccaagcgcggtactcgatgcggtaggcagttattgcggtggagcatatatctccaactacaaccaatacggtaaggtatatcgtgtaatgatgcaggcatcgcccgaatatcgtctggacgagcaggcattgaacaatatgtttgtgcgcaacggtacggaaatggctccggtgagccagttcgttacactgaagcaggtactgggaccggaaacggccaaccgtttcaatctctacagcaccatcacagccaatgtgaatcctgccgacggttactcttcgggtgaagtgcagaaagtgattgaagaagtggccgcagaatcgcttccgataggctacggatacgaatatggcggtatggcacgcgaagaagcaagcagcggtggtgcgcagacggttttcatctacgccatctgcatcttcctgatctatctgattctggcttgtctctacgaaagtttcctcgtaccgtttgccgttatcttctccgtaccgttcggattgatgggctcgttcctgttcgccaagatactcggactggagaataacatctatttgcagacgggtgtgatcatgctgatcggcttgctggccaagacggctattctgattacggagtacgccatcgaacgccgccgcaaagggatgggcatcgtagaatcggcctactctgccgcacaagtccgcctgcgtcctatcctgatgacggtgctgacgatgatcttcggtatgcttccgctgatgttctcttccggtgcgggtgccaatggtaacagttcgctgggtacgggtgtcgtaggcggtatggctgtcggaacggtggcattgctctttgtcgttccggtcttctacatcatctttgaatacttgcaggagaaaatccgcaaaccgatggaggaagaagcagatgtacaagtgcttttggagaaagagaaaagtgaagctgaacgtgaacgttaataaataaaagaaagaatgaagaaaaatatcatcctgttagttgccatgagtctgacgctgagcggttgtggcatctataccaaatacaagcccgccacttccgtccccgacgatctttacggcgggggagggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcgagacagggttgcggaccaataccgactaccagtccgcccagctttgtgtagaagaagctcaggcagtgctgatgtccgccaaacttgctttcctgcccgcctttgcgctttccccgcaggggacagtgagcagcttcgatacgaacaaagctacgcagggttattcgctacccgttaccgccagttgggaactggacgtattcggccgtatgcgcaactccaagaagcaggcgaaagcgctgtatgcacaaagtgaagattaccgtcaagcagtccgcacgcagctgatagccggtatagccaatacttattacacgctgctgatgctggacgaacagctcatcatctcccgacagacggaggaggcatggaaagaaaccgtagcctctacccgttccctgatgaacgccggactggcgaacgaatcggctgtatcgcagatggaagcgacttattatcaggtacagggttctgtgctcgatttgcagcagcagatcaatcaggtggagaacagtcttgctttattattggcagagacgccccgcaactacgaacgcggaacgttggcagaccaacagtttcctacggactttgccgtaggaatccctgtccggatgcttgccgcccgccccgatgtccgctcggccgagcggacgctggaagcagcgttctatggcaccaatgcggcacgttcggctttctacccttccatcacgttgagcggaagtgccggatggacgaactccgtcgggtctatgattctcaatccgggcaagttcctggcatcggcggtaggttcgctcacgcagccgctctttaataaaggacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctgttgctggacaagcaggtcacttccctgcaaacggccctgcgaagtacttccctgctgatggaacatacgaatacaacctatctggaagtacttaccgcccgacagtcattgctcagcgcacaactgtcacaaacggccaatcattttaccgagatacaaagtttaattaacctataccgtgctttagggggaggtcaggaataaagaatatcatacttcctctgttttttttgatcctaatgaagaagggctgccggagaagtgattctctgacagcccgtttttcgttagaggcattcccgatttgaatcaataacagaccaggaacggaaaatacattcctaatgtgcattatagcctgtatgttattcataaacagaaaacatattgcaaaccgaattggccaaatgccgcaacccttctccgccgggcaactgaaataaagtcatacaccaattatcgtttccttccaacatataaggaccggtttcggttatcgcaacatcccatccgatacttctcactttcggaattctcatagcagcttgtttggctaatgctattgcctgatcgtaatatgggattatgcaacctgttattttttcaccactgacaggatgtatatgaaaccgttctcctgacggatgttttattatagcaggttgacagacgacaccccgatgatcaacaaggacggcaattcctcctgtagcaaagttgtctgtgcgagcctttattcctatacgtaaaacaacactccacacatcgaccttatttatactttcatcataatatgtcacaattctcaatgtgttgagacttgacggattcagtttattcagggcgctatgttggataatacgttcttcgtacaaatattcatccggtttttttacagtagaaataacatagtcatgtagttgtcgcaatgatgtaaagttttgcatcggaaaaataatcccttgaccggcttgtccttttatgggtttaatgacgacctcatttatggatatggagtaaggatcatgcatttgcctttttatctcatcaaacgtcattacccggcgccctaggatatcctcaaaaacttcggaaaaacgcactttatcttttaacactaacgcttcgcagggatcgtttacttgacgtgtcaattcatgacgtaacgaagaagtgagatactgtcggcattctgttctgcttttcttaaagaactgcaactcgtagtagttttcgaatgatgcaccatacatccaactatgtgacaatagctcaaggaacatcagtttcctttttccgaatacgtaatgattatattctctcagctttcgaaaatctgcaattcgtatatggtacaataaatttcttatctttgactttaacttgaaagcattattactgctttttgtaattgaacgggcaggaactccggcaacagtagtatggctgtcgatatttcgcgtcactacagcgcctgcacctattttgcagtcagcaccgacaatgacatcaggaagtattaccgcattagcacctatctccgtcctgtcaccgataatggcacgtcccaagacttttgcaccgggagatacttcacaatatcgtccaatacggacgtcatgactgataacagtgcttttattgataaatgtcccctgccctatacttacattacaagtaatagttgcccccgaaagaattacaacacctggttcgatagtattgtcatacccgcccacaagggctttttgggagataaaagtggtcaatactcctccaagacaggcaatctttcgtgccagtacctctctacgctgtccacctccgacaccaataataaccttactgtctgttttcagatgttgctccagttcattccaggatttaataatgggaaagtcataatatgcatcgctaatatctgtatttatattgtcaaacaaagatacagtttcttctacattatcccacttgagtgctgtcaaaatctccttagcacatcctttactcccgattattaccattttacacttttctattttcgacgatattcagccaagaccatgtcaatttgattaatttcatcatcttttaaatccacgtgcaccggcagacaaagcatcttctcagcattcatccctattttgtaatagagcggctttctaaaaatgacactacaaaataaaaccatttatagcgaataaacactatcaaaaagtacgataatatcctcctttcatacagcactgatatttctttttagaaatttcatatctcagcttgataacagtctattaattgctttggaatatattgaaattgttactgcctaataaaccgactgatatgacaatatacgaatagttcataataacagaattatggaggtttgtatgttatatgcggataaagtgaaatgtctttctataaggtgaaagcgatgaaagcggaaaaatggggcaaaagcagaaaaggttcgccctatattactttatatatcggcacttatgatagtaaaataaaccaataataaaaacaataatagtgggaagtatatgtgtctaagcatccccattatcataatatattcttctgattgttttgtaattaccccatccatactctatttatctttttgaattaatattctgaccaaatcactttccttgtacatatattttccaccaatgaaagaacatggaatgatcccataatccctataactttgtaaacttcgtttagagatgttcagagccagacaaacttcctgggtatccagtcatttctcccttttaactgttccaaacttctttttaacggcttcaacttgtacagataaatccttaacttgctgttttaaccgtaaatacgcacttttttctataacaattaattccataacaaatttgatttatgattttactatttacaaagcaaataaaagcacatttcaacatccgacaaaacttcctaaatcaaagtcacctgttggcgcacattgtcactcctcaaaatacaagatattaagaagtgacctgaaatatttccatactactattcctttacccatatttgctcaaaccaaaactttaataatctcaatcataaaaggaaatgcctgttacctgcatccatgcagtaacgagcattccacccctcaccagttttccgttatcctacatctttatacctttgcttttctgcacaaccgccttttcctttacgtccgctttttgccgtgtcttcggaaaatgctccttcaacagcttccctccagtttcttcgccttctcctgcagctcatcatacacatcccatctgttccggcccagcaacttgttttctatcttttcaaatttttcatggaaactgaactcgtccggatattcatctgtcagcccgtctctcggataacctttgtccatgatatatagcagtgtcatccggtcataattatgttggctccgcgtcagtcctagccccttgcctgcatcagtcaacctgtaatagttctcccatgtggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttccatcagcgagggccatcccctcaattcatggacagccagggatttcaacacaaactccgaggcaaagaaatcattctctatgtatttatacatgtaatcactaaattggccctctccgattatgtccctgctgaatatcagcacccctttgtccgtctcaacgcccgtataatacgtgtttccatgcttcaaatcatccagcatctccgctgtcacttcgggcgacgcagcctttatctcccgccacatctccggtgtaagccgctggatataattctcgtcccttgacagcggatccatgtcttttcacaggcaatacaccacctctgacagacgcaggtatctatgcagtttgattccatgtccgtccatcgccttttccaacctttgcagataatcatcattgttcccttcccacaaatgcggtacaatccccatatcaggcacgttatagtacatcatgcctataacaggcatttccgtttccttcagtgccttttccacatcttccagcataaactccagaaaacctttctcgcctgtacctttcatgctgacatgcactggtttgaaatgtccgtccactgtgacatacacactgccgccgttcgtattctctttttccatccgccaaaaatttaaatgttcattccttgtccttttctctttaccggaatccgcaccctcatttccacgttcgggaatcgcacgttatccggttgtaccaccagtgacgagactatctgctcctgctctccggtcagcggtataggctgccgttgcagatttctcagcttgttgaagttcctcagcgtaggtgccatgtcgcaacatgccacacaaatcccgtatctcaccatatccgaagaaaccgtctgtccgtcaccgattttagcccggtatgcagcatccagcggagccacttcataaaatctcagactcccggatttccgcttgccgtcaaaaaaacgttcggccagcctgctcagaaacgcatccagcatcctgtccccactgtctgtcttgtcaaacagcaataccttcccctcgtattccaccaccatgcaggtggggaaagccgccagcccgttgcgtatcacatccccgtccattccgaaacggtgtcccagacgcctgtaatcctcgttttccagcaaggtcatatgttctgccgatgatgacagatgcgcaatccccctttcctcgcagaatgccgcatcccggagcctcaccacccccgacggatgtatcctttcccgttccagcaccggacagagccgttccagataatccgcattgtccgtaccgagtatgggaggaatcatgcctttgtccctaaaatcgaaacggaacattcagtggtcgggaacaaatctccgtcccgccgtatgaaacctcacgttgttgccgatgtaacgagagaatccatcttccccctgcccgcgtatactcagatacacgggtttgtaaaaagcgtccagtgtcatgtacaggctaccgctttccaccgcctgcattttctttttttccataaattctataggattaattgtttcttctctttcttttgcggagcaatgggggcgacgtgcctcgcctgccgttgtctgtcagaaggcttttgtctcggtgtttcctgcctgcggtatgtctccggtaacttgccggtcttcacctcttccgaatgtggacgcgacatcggatgtaacgtttccatcctttcaatccagcttatccgtgcgcccagcctgaactccccatccttggcatggaactccgattgcaacaagtccgccgccatctcccttgcctctttctgcaaggccgcatagccgaagtcgtgtgccgacagaggcgcgttcatccgtgccttcatgctgtcttccagtttctccgccagttccctgaactcatactcatagctgaaaggatgtaccttgtctgccgcaacaatcccggcgtacccgttttccgaaatgtacagcaatgccgccacatcatagttccgcggcgagatgcccagcccaaactcccttgtcagccggtcaaaattatggaaatcgggccgcaggtcaaactttgcccagcacacaccaccgtccaatacactcctgtccgcaaacttgtcgggagtgaagctcaccaccgacctgcgcaattgtgcgtccgtactccgcaaatccgctttggacaacttttcgatacagttgtctgccagttccgctacccgtttggtaggcaggtctatctcgtatatccgcagagtttcagatactttggccacgttgaagaagccgtcggccagatgttgcagataactgttacgtgccttcattcctttcggagtgtccgagaacagcatcaccccctcttcggtggccacggcatacacccgtttttctgttccggcagcttccgttgctgtcactttctgccggtccgttctccggacgatacggttccaaatatcattcaggattgacataaccttgtttttttagatgtgaataaccgacggcaaaaaaagccattcgcctgccaatccgcaataccgaacacatacaagtcgtccgttggcggctgttggcgtgcaacctttacgccagccgtgcgtcaagcatccggttgtagctcctgcgcagggagtcgatgaacggagtggtgtccgtacaacggtcaaacacctttccacgcttggtatatagggcattgattttcaagtgaaaaacttcctcgaacacccgtatcacatccaccactttcagttccctaccttccgctgttcctatcactccggcagccatcaacgccgccaccagttctatcaagtcgctgtccgtgccgttccacgtcagcgttacagaacccttcttcccgttcctgcataccgcctcttccttcaatcccattgcctccgttccaccatgccggagtacctctttcatcatctgttcctccgcatccagcaacgcaagtgccttgccgatgtaaacatcgaacagaacgtgcctttccatgccatttgtggaaacagtctcctgaatccccctcaactctattttcgtgtagaacagcctgcgcagctgtgcacagatgtttgtcccgtctgtcgggagcgtagccagcaacgtggcaaaatcatcataggcggcagacagcttctcctcaccgttgcggactccgtccgcataagaggcgaacaatccgaacaagacagtatctttcaagattttcatggcaataattgtatttgtttcatttacatgccatagaagggcaagaaagataccatcgtacgaatttagttggtagtatcaaagacaatctactgtattacaaccacttgtaaattttccaaaagaacatgtatatatcaatgtgtcgtgtaaaagccggacacgtgtacggaagccggacacgcggttattgaaagccgtacttccgtaatttctcataaagtgtgctccttgatattcccagcagccttgccgcctccttacggttgcctccggtctcttccaatgcccgcatgatgcattccttctctttttgcgcatcattcagcgcaagcgtctctgacgcatccgccccgtccgcttcccgaacggaaaaagccagacttccagcggctatccgttctccgtcgggcgtaagcagtacggcaccccttaccgtattcttcatctccctcatattccccggccactgataggcagccagcctgctccgggcctccctgtcgaaaccacctgtccttttgcccagctcggcattggcctcttcaagaaagaagtccgcaagcggcagtatgtcctccctgcattccgccaacaacggcaggcgtatggtaaattcattcagccggtgaaataaatcctccctgaaacgtccctctgcaatggccttctcaagattctcattcgtggcggccaccagccgtatgtcaaacgggtactccctcgtgtcccccagcggcctataccgtttttcttgcaacgccctcagcagcatcacttgtgtccggtacgagaggtttcctatttcgtccagaaacagcgtacccccgtcagccgtccggaacagtcccgccttgtcgctctccgcacccgtaaacgcccccttcagatgtccgaagaactccgatgccgccagctcttccggaaccgtcccgcaatcaacgggaacatacggcttgttccatctgtggcttcgttcatgtatctcgtgcgccacatgttccttccccgtgcccgacgccccccgcagcaataccgaaatgtcggcgcacgctatcagttctatctgcctgtacatctcctgagccttcgcgctttcgccacggtagaaggacggcttgccgctgtctccctcctttattccgacgataagctctagcaggatgtcaggctgcacgggtttgcgcagatagtccgtggcacccagcttaatagctgtcaccgcattctccacttccccgtagttggtcatgatgatgaccgggaccgtgcaccgcctttccctcatccattccagtagggacaggctgttgtcatccggcagacgcatgtcggccagtatcagactgaacggcttccccgcaatcgccctgcgcgcctccgctatggtcgccacgcactgtgtcttcatgccctgtttcaccagccaattgcttatggtacggctgaaaacgatgtcatcctctataatcagtatgctcttcatctatactctccctgatttttcttgccgactccgccagcttttccgctgcatggattatctccccgacttccatatattgcctttcctcccacacagccgccgtgtgtgtcaccagaccgcgcaggcgggccatcggaaagttcatccgcaccgtttcccataagggaaggttcttgtgcagcaccttgtgtatcgtatccctgtcatgcccgcaaagcgcattttccagtgtatggatgctctcttccgtttcccgtataaaaatatccagcatccttcccttgtccttttcccccgaaaggatgaacgagaaatcgggttctttcttccccgtttttaccaccatacggcttacggtgcttatcagttcgtccatcgagaacggcttccgcaggcagcccgcaaacccgaaggaaatataatgttcttcatcgtcggcgcaggccgtaactgccagcacgggtatcgtacgcgcgttctccatgttcgaggaacgcagcagatcaagtatcctgtaaccgtccatgtccggcatctgtatgtccgacagaagcaggtcgtatgttctttccctcagtgccgccatcagttcccgcaccgtccggcagcattcgcaccgcaccttgttccgcacaagcatcctgcgggttatatccagttgtatccggtcatcatctataaccagcacgtatgttccttccagtccgtagtcctccgcatacccgttttctccatcctccccatgcttcgccacttccgacagggggagggccaccctaaacaggctgcccgtcccgtaagggctctccaccgtgatgcgcccgcccagcagttccgtcagacgggagacaatggctagcccaaggccgaagccgggcaggtaccttgcattgtccagacgctcgaaggccctaaatatcctcttctgttcatcctccgtcatgcccggtccggtgtcctgcacgctgaagcgcagctctccctgcccgtatgccgcctgcagactgattttccccttccgggtgaattttatggcgttggaaagcaggttgttggctatctgcatgatacgcgggcggtctccttccaccacggtgtcaagtccctcaaaatccgtacagagtgtaagcccttcctttctgaccgacggtgtatgcagcttcactatctcatcgaaaagtgacagcggacggaaaaccgtcacgttcattttccccttgcctgcatccagcagataaaattcaatcaaggagttcacgagtcctatcatatagtcggacgagcggacgatatgcaccgcatactcatccttccgcttttcgtccacttctccgggcaacagctctgcataccctttgatggctgtcagcggcgcacgcaggtcatgggcaatggtcagcatcatgttttttctggattgcagcagttccttgtttttcaggtcggaagattccagttccctgcggtaccggagacacctgttcacgtcgcggtgcagcagggtatatagcacgatggcaagcaggaatacgaaaagggcaagcgtcgccgccgtattgtacgatttctcccggtctgccgcaatggcattgtatctcgtttccaaccgctcacccgccaccttgtcaaaatcaccgaccagcccgttcagcctcttgttcagcgcccggctactcaagtgcaggctgtccatctgggccgacagcttttcccgctgttccttctgcttttcagtcacttcgcggctcaacgcatggagaagatggacagcggcattgttcccgctgtttcgagtggtggacgacggcactttttccgatgccgcccgttgctgctcccgttgttgtcggtaagcggattttttctcttttccgccgaaaactttcttcagaaaacttttcttcttctccggctgttcttccccggtggttgctgtcccggcataagcttccttcacggcaggggcgaggatattccttgtcggctgcctgcgcacctgcctgacgatagccggcactttttcgcccaccgtctcgccgatgttttccagttcgtcaaacgtgctcatggccgctgacaggagcatctctttctgctcaagcagcaggcacagcgagtctatgcgttcctgctgttccggcgtatgtacaaactgctgcagttccttcaggacaccgcacgtcttttctcttctctcacggtatagccgtaagtcgctttcgctccaggtgctcaccacttcgccttgcgacgccagttccagcagatgaccgtaagttttgcgcgtaaggtcgcgtattatgcccagttctttcatttcccacttcagttcatcccgtttcatacgctccccgcggaacaggtaaataatgaatcccaacagaagtatcagcatggcataacctatgaatattttaagtttcaatcccattctcccaaccgttttgttctattcctcgtcctcatacgcttttctgccctgtgcactgcccctatgcatacaagggtaacgaaaaagctcaagaagatacagacggacaacaccgctatgactatccggcagttcataagtcttcatcgttttctcctgctccggcaaggtgcctcaccagtacgattccctcgtcatggattgtgaagaatacgcaccaggtgacgttcatcatgccctgcatcttgaaccgcacccagaaggtgtcccgtccgcaataccgctcgaaggctttcggcgttgccgccttcgtccggggaatgggtgtcagcacacgcacgatgcggtgcagcagcaagtccggaaactctttccttatcacactcacaggccttgtacgcgggcttacgaacagcctgtccgtttctgtctgtatttgtcttttcatttccggcagatagcgcacatgttgttgcacctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttacttgcatcggggttccgtcctcgtcccgcagcaaggttattccgttgtattgaatcatttatggtttaaataatttattaatttgtaattcatggtttcttgccctgcctcacccatccggccttagtccaatccctgtccttcatcacatccggagccacggccccctcataatccgtccgttcaaaaaaggtatccagcacaaacctgtcaggggtcagggaagtcacttcacgcgtagcgttaatcaggatataatcgatacccggcaacgctcccggttggccaccaatcagttggacaggaatgtcatcatctgccacagcctcgcgggtactgctgttcaccagtgtcagccggctatatgcggaaaccgcaatcggataccgtcggccatgagatttattatcatgcgccgtagacaggttcgcaatcaccggatgtgtatagaaagacggaacttccaatttccccgtcccattgcagctaaccacgctccacacactcttccgaataggtgcagtagccatcacatactgcaatttccccgtatatccttcattgaagcacaatccgttctggctggcacccgtactaatcagatactgggcattcaccgtccctccgttgaacataaacccgtcgccaccgctacagtaactttgacaatggtctatcgtagttccccggctcacaccgtcaaaggtcactgccccgccggcggcaccggcgtactccacccggacaaactgtagggaaccggaatcatcattctcctcagaacctccataagaaatatccgtagcaacagttccacaatataaagtctcacactcataactgacaggagccttccccaacacaatcacaccgtcccaactacccggttctttgatcaatgccgtcatcacgataggagcatcctccgtaccgttggcaacaatcttacacccctttgtaatgacaatcgtcgctttcccttgacccgatgcgggaagagctttcagcaatgcgccgcgttgtatggtcagcgtggcgccgttggtcacaaacacaggcttactaatcagatactccgtatcggtgtacaatgttctatcctcactaatcaccgaaggcagtacctctgtagtctccctgtcaaacatctcgtcctcattggagcaggacgtaagcatactcagacacatggcagccaccataaagagaaaagcaacaagcgctttccggcaaaggattatttcttctcttgtcatcacaatcttttttagtttaaacttacactggccaatctctgtcaatcaacaaggattgttcagaaataacggccaaacaatcttttaaaaacgccctttttctcttccgctttttggggtatattctttagttcctgaatccgggcttcaaccgatgccagctcgcgcatctcccgttgcgattcttcaatcagtttggagtcgcagaacatggtagttcctcgttgccagaatccggtattttcttcctgtatttcttcgtcaggcattataagagtcaatggcccctccacatagaagtaagcctcccccggctcagccgctctacgtttttccttttcctcacgccgcctttcctcggccatcagcatttcccttcgtttcctgtcgcgttcttccagttccaccaggtcagccagcctgccggtattataatactccacctgcgccctttccatgctcaatttctcttgcatgtacaacggtatctgttcccctttcgtcattgcgtaggtgatgaatgtcttgaagagatacgcttcgtcatttaacacaatccccagcgcaacgccatgggaggatgcgctgtatatccgtgctccggtcacccgttcctcgctgcccggttgcaggccgtagcgcatcacgaggttatccttcaaataagtctttctcaaaatctttccggacagcgtactgtgttttccccagtaccgttcacggtaacgtataaaaaaatggggagggaaaacaaaaacagcattctcacccgtgtccatcgtgacaaagagataaacatggaaaccggcattcgatggtaccaagcaatagaactggccgcatctatctatagtctgctgcttccattcctgcttgctgagaacatagaatctcactccccattccattacgggagtgttgattaaaacagaatcaaccccggacgggaatctggccattccctccaccttcggattcagcaggatatgctttcttcatgctttggaacgtacattagtcttaagatcctcgcgaagcacctcaatagtttcttcaatgctcatcttggatgttaccatccgcatgggcttcttatccggtttcgtttcttgtttacccatctgtcatgctgtttttagttaaagacaaattctcttcctccgctgcctttttgaatagacggtccatttctttcagcacactctccagcgacattagattatcgtaagctgtaggctcctttatttggggcaccgattcaacgaacgtaccaaactcctgaagcaacttagccggtaagtgattgacggcccattccagtagcggcaagttgctttttaccttttcatccataccgttatgcacctttaccatcgcctcattcttcagcagagccatctgcgggtttatcccggcactttccggatgtttccgtttctggtcatccaatccggcagtcaactccattgatttgcacagtttcatcatgtcatgaagcaaaatgtccaatgctttccggtctttggccgattcccgataaccgttacatttcaagatgaacagtttcacggcaagcgctccccacatcggtttcaagtcctcgtcatcaaaaaactgttcatagctcattatcttattgatgaccgccagtttgccgtccttatcaatttccccgaatccaaccgcatccacggaggcaataaatatcttatcaccagccgatgcctgctccttctcttcctttttccggaagccgacagcaaaaacgtagtttcgtccaaagaaacggtacaacaaatcccggtcattcgctctcccatctccgtacaaagcggacagaccatccgcatgggaggagaacatcaccagttccacccccttccaagcggcagcctgcaagtccagataagcagccaccccatcttctgcattacccagcagataggcgcagaggaagttcttataactgaacttgggcacttccgatttccggttcacatgccctaccgctatccacaagttacccgcagcggtccgaaagacgcacggatcatccgtacaccatgggaaggctgtcactcctttcagcacttcccggtagttctgttcttggattcgttgtgatatcatggcttgcagttccggcatatcagtctgcatcccctttcttttctccgatgtggacattgtttttgttatcacgctgtgtccctccttgttaagtacgaacgtattcttatattactttctcaatgcttttccgtcgtatgtcacctccttcaacatgttcttggcatattccacagccttttccggcagcggtgaacattgcacctgggtagtgatagtctgagcttccgggctgatcagccattccagcagcttcacggtttcttccgcttcactgcgactacgcccggcatagttctgctccttataaagtaccacccatgtgaagcaactgataggataagcgtcggcaacctctgaatcggtaatcatgcccgtagcatcccccacgcttgcgacagcggtaacgctttccgaagtgggctgcacaaagtttccggcagcgtttttcagccatgcactctgcgtattgaagctggctgcatattccgaagccacgtatccgatagcacccggaactttacctaccagtccggccacgcccgtatttcccgtagccgctactccacgtggaaaggtcaaggcttttcccgtgccaatcttggccttccagtccgtactcactttcgtcaggtagtcactgaagatataagtcgttccgctaccgtccagacggaaaacgggatagatttccttgtcgggcaattgcttgccggcgttcactgccgcaatccttgcatcattccatttcaatatcttacccatatagatatctgctatcagctctcccgtcaggcgcaggttatccacaccttccaggttataggcgatagtcactgcccccatgcacgtaggtacaaggatagattttaccggcagactgtccagttccgctttggtaggtggaacgtccacacctgcaaagtctatctgttgattcttcaggcttctgaatccgcgttccgtaccgataccggcataagtaacggggatgtcgttcttctcccagtacatcttgaacgcctcgctgtagaaaggtaacggcaatgtggctccggcggcggtaatcaccgatttacgacccacagcggcattttcggataactcctcaaccggttttccactggtaaataaagttgctgccgctattgccagtacagctacgaatgacaggcatacaccgcctgttttactgatttctttgtttctaattgttgccataagcatttttattattgattaaaattatatccatttcagacagagtgggacaaaacgaaaccgtcccgctaaccaaagtctttcgttggttagcgggacggaaataaagaatatgtctgagtgatcgtttaaaccatcattttcaaatcataatataataaccttgtatgagaggcatcctcatcacttgatgtcaactctaaaaaattattcttcagatagaaaggtactgcatcaatataggcatcaactgtaatgaacctacatccggtcttattgttaataacgaaatagcctttaatgaaattaagcaatttgctgcccaagtgcaaattatgtgtcgaaacatctaccccaaagcggcagattttcactgctggataacttttcagacgcttctcgttaacaaagcgttttttccgaaagcgattaaattccgtcttgttctcaaattccgaaagagaaattttatcatttgccagactgaaatatgccaaaactttgccaaaggcatcttccactacataactaacagcaagcagttcatttctataaatgaaagattcattcataataaaatcgttcaaatccgcgtctccgcaatcgaacgattctattctctcgtgttcatccaaacggcgaacaccaaactctggattatttatttctgccatcagtttcttctttaaaaatgctcatgatgtacttataatcccgttttatctcttccagcttttccggagtctctttcggtggatttttcatccgcgcttcaaatctccgtgcatcctccccgaagagtatcggagtttcttttatcggtcttgccattattgcctcctttctctattgttatctgcaaaggtaatgctatttatgcaaatacacaaacggtcaaggggttatctttatttccgtatatgtcccattctgtcaaagagcgattgtttttcaaggccagagctatttctccaatgacgatagacagctctgccttaaagtcattaaaaaaggttatcccagtggattttcttcttggtttctattccttacgtgttactatatatgtcattttattattgttaacacataaaatttcatggtctgcttatttccaatgcctcaattgcatttatcgtatccttaggatattcaaaatgcacggaatcacatgaatgctccactctgacctccgcagatcgatattcctttgacttcttgggtgcatcccacgatttgttactcaaaaagacacgatactcatagatacatccttcatacagttccggcactatgtaatccaaagtatcagggatattatccgcatatataaagtcatttataaatttggtatagtcccccttcggatagtatattcttaaacaaaattcggccttctcataagtgtccgtatttgtgatattagctttatcaataaacctgaatacgctttctttctcttcaggttgtgtctctttctcattatcatcgttttgacaagagaatagacaagcaaggaacagcagtacggttagtcttctcataatcaatagtctttaattgttaatgcatttgctttccatatagtgatatatccaatattaattctgaaatacctactctttttttaccgtctcaatacagttttctgtaaaatctaaaatatttagtcttgctgaaatgtctggtttcatgagcaagcacccggtctcctacactacattcctccaggggatcatgtattttatactttttcgtatattgtactgttttcccatacttcggatgctttttcgtacgttccacctctatgacaaccgtcttttgcattttcgtgcttaccactatcccctcgatacattgccggggtattctttttacagctacctttggagagttccataagaaaggccgtaaacggcacggcaccatcttaatattgaaatagctgaaaatagcgttccattcactcatcacattcagcaagccgttatattgctgtgcagtgatttgtttggtattgacggcttccagcattccgaacagttctttcactttaggtatgataagttctatatccttagtttgcggattacctgtattcagaagatgaaatacccggctgcacagtgcctcatgttctttcaatatttcttcaataccattttccatacaatccgttatttgaggttcaatgcacaatggtagatatccaaatatcccatcaggatgatatccgcataatcaatgatgctatagaaatccgagataaatacccgttggttcgttttgataaagtcaaactcactgtcgccccagttaccgagaggataactgccgatggttttcattattccacagaattgttggtgcaactggaagatttctttctgtgcattaagtattttccgcaatatggctttcatctcgcaatcatttatcccggaaaactccacagacaagtgggattcgtcctttatgctcaccaacagattttcaaagcagggacgcaactgggcagaaagttgtgtttgagcgatacgtgccgacggcgtttgcagggattctttcagtgcatttcttaatgcccggctccggttggtcactattttctcgtagatgacgggattagtcaggaaaacagctacaaggcgaaaatcattactcaacgaatgatacttctgatgtatctcttttattgctttggatttgacggacaattgcttcagaaacaacagcagcatttcattgtccgcctgctctttattcattccatgcgcaaagaacttgtcattcatctgcatggtaaaacccagaatagaagctatatttgctataatgtctatcattcttttattatttcaaattattcaatgaaagaaagcatttgttttgatgtctgaaaccgctttatcgaagagctttagatagccctatctaatctccttagacagctctgtctaaaaaggccggataagaggctttatcctaaaggattctcatccaagtttccatcactggtatttccaccttcagaaccaccactttgcccgatggtaatcactttgctcgtactacgcggagttttcagcaatgtatttgtaccactgtattgcgtagtgaccgtcagcgtgtagtgaccgtccgttaaatcggagggaagcaagataatgagttgcgaggggttgttcaccaccagcatatcattaggcagcttgctgaccttgccggaagcatcagtcagggtgatacctaccgattcatgttcaccaacgacttttatcaagcgtccgttcagggtgtagttgcgtccggcggttgccatgccgtccgtggcacgggtggcggcatcttcgccacctattatatacatggcgtcccgtttctctcccaagatgttgactgaagtctgcgcaatagcttcgcgcaagtccttgtcctgggtaaaggagacgtagattgaattctttttttgatcccactgtccgccgtctactacaccacggaattggggtacggctcggaaaagtccggtattcaccgaatagccgctcagcatcaagtctgacaacacacggtgatatagcttcactgcgtgctcaatggtttcttcacgaagacctgtgtcttctttcttcatttcgctaagtatatcctccagcgtaaggcttccggctgattccaacatcaggattttgtcttctttgttgtctacggtgacagcattgtctaccagccaacctttcagggtgtgtttcatgatttcttttcgtttttaattaacaaatactcatttttaggaaaagcacctccgattaattaattttatcggagggctttaagtaccaaagctctatttccaaggagtagataagataaaattgcattgcacattatcaccgccttgatgtgaaggatccataaagcgaaatgtcatgaatttattatcagaagttcctattggaatacttgtattaaaatgttccagattattaactatcatatttccactctcatctatcaaatcatatactccgtttactacaccttggccaaatgcatcattatcgatttgaatatactcagaaatctttccagcttccaaatcaattgttgctattggggctgtaaattgcatagcatctaaatccatcaaataaactaccaatttcaacttgtcatggccgggaaaggcatcagcagtataaaagaaacgaattttagtatattgtcgagattccggatccgcttcttcaccatcggatatatccaagaagtctgtatcggacaactgcataagactgaactggccttctggcataatagtcatatcttgttcataaagaacttgcccatcaacattgcgcactatttttaatgtaccgcttaagtccgcttcggctatataattctttaccttatttgataattctccattattgaacgtaacggtatataaatcagtattaggattaaaatagctaattatgggagtgaatgttgtatattcctccaaagatgaagaaatagcaatatctcgtcccacaagtttaagcaactcaatgtctttactattatccagtgttatctcttgtgacaattcgggctgtttttcgcctattttatagacctctagtttaagagtactattctttttaacagatgttgaacgattaatacttttttctccattaaaataaacctcataactacttcttagttcttgttgtacaaacgatacagtacaagtctcaaatcgcatgtctatatcctcaccttctgtttcacaaccagcaaagacaaatataaaaatgctaatgatgagactgtataaaaatttattcatcatttttcttcaaaaaagagccgaataaagagggaggctaatccctcttttatacggctccaaattattcaacaattattttacccacgcttgagttaaccagtttgaacgtccaccaacagcacctctgtaagaagtagtcgtaaaccaactatccaattcactaaaatctgcacctgcattggctggagatgcattaggcatcaaacctgtatatccaccccacggagaagtcagcccaatagcctcagcacttgcagcagcagtattagtcgcgtcagctgtgatacctgaaaatgtagtactaacaccatttacaacattgtttttgaaaacatagctgttagtggtttcacacaagataccggtaggatatccgtaaagaatactgttcaccaaagtaaattggcagtttctacggaagttggcacaagatttcatggatttaccatcacccattgcagattgtgcaaccttaccattaacggttccaacgattgttaagttactgattgtcgggtgagtgaacggagttaaagatgaactgcttccgtcgttatcacattcaataccattcgggtctttagtgtaataggtactatttgcatctacagtggctaccaagaactgaagcttaccagtgtaaccaaagtcgaagtcaaaagcatcgtcgtgcgtactggtagataccaaatacttggcatttattgtaccaccgaagaattcgaatgcatcgtcttcaccgtagtatgcctgacagtggtcaaaagttgtacctgcacctacaccgccgaaagtaaatgaattcaattcattgtcctgcgaaacgttggcaccggcatattcaacacgtacatactgaatcgtaccggagttatcgttagcattgctaccaccataagtgatatctacaccggcaggagccgaattgataccttcaataaccggattgttggtttggttgataggagcattacccaatactacgaaaccaccccaaccaccaggatattgatgtgcatcttctgccgtcataacaatcggagcagaagcagtaccaacagcattaatcttaccattacgggtaataaccaaagctgaagcttgtgccggaacatcattgtacagacctacaatttttgtacctgcctgaatagtcaatgtagcaccaccggacacataaaccttgccatccaaatgatattcatttgaagcactccaagtagtattggtgttgataacaccagacacttttacgattgcagcagctgcacgagttccaccgtcaatgggtgcaatttcctcgttctgactacaagataccacggctacagaggctactgccaaacttgtaacacctaacacgtttttgaatctaaaatttttcataactgaacaattttaaaagttaataaactatttatttaacacaaaaactaaaatttatatccaactgacagagaaaggtttatacctttttttatccggcttagcacccaatctccgctattatagttcatatttgaagttaaatcagcatatcctttatcgttattcgggtcaacccccggttcatatccgcaattgcgataaactatcacatcctggtttaagaggtcactggcattgaatttcacttccaacttttcttttaggaaacgggcagagatttgtaagtcaagtacgtctctcgatgcttcgtattggtcatacttctcgtaatctccggcaaataacaatttacgtccgttacgcccatagttcaatgcagcaccaagtatctttccctgataggtcaatccggcatttacagtatatggagacaatccttgcaatgggcggctgcggtcttgcgttttaacttctctgtcaatcccggaagcagcgttctgcaatcgttcaagattgtatgtaacgtctccactcagaaaagtagcgtttccactgacatacacatccttcaagaaagagcccggggcgatgaaagccaatgatttacgaagattaatctcaataccctttacgctggcatcatctatattgaaaggatgcaggacatatcgtaaatccatcgtctttcgcgttaccatttcaataggggatttgaatttcttataaaaggcacttaccgaaaccacttcacccgcttgtggataccactccaaacggaggtcgaaattatccgaatgggattgcttcaatcctccacggcttttcacttctatacggtcgtctacattataatagttacaaggggtaagttccctgaagtccggacgcgcaatggtgcggctataagcaaaacgggcattgatgttgtccgtgatgttatagaccagagtggcggcgggcaaccagtcggttttctttaccgagaccaaactatccactctgtccgccccaattgttgtttgcacttcagtagtggcatcttccatacggacgcctgccgttaagtgcagtttacggaagaacgtaaattcacccatcaaatatgccgcatgtatattttgttttccttcgtagtaatcggcttcatttagtcccgacaagccggacggcgcataatagatagcgccacttgcaaagttcttcgggtcatacaactctcccaattccggatgcgattcctgtagttctttccatgcgtcccatccttcccccttgttgccaaacatggcatgaagatattgctgttcataattggaggtacggaaagtgcccatatatccggtcttgatggtttgcttgtttccctttactacaaaaggatgttccagattgaatccaatggttttcttcttctctttcaggttactgtacatcaagtgtccgtcttcaagtccgaactggctgctggtgacagtgctgctccaatcaaccaagccgtcttccacatttccttgaacattgcccaatgcgtagcggtcatccggattggtacggccaatctgattataagacgcattccatgtagctatcaggttttcgttgaacaaccggtgctcgccttccagttgggtttgccagagctggctgcgcaatgggacactatactgctcataggtattgaacgctgtagtatatttaaaaatgtaacgttcaagattggtatgttggaaacggttgttgaacatgtttcgccacgtaatcttatggttccggatttcccaaccgacgtttgccacagcgccgacagaagtcacaaacttatagcgtttacccggtccgttcaaactgtctttagttatggtgttcatctctttatattcttccgtagtctgttcattacggtaggtcaaagcggctactacccccagtttgtgtccgtaacccaattcgataggagcaccaaaggtaagagagtagttctgtatcggcatagctgtgaatttcttcattccgaaagtatttttcaatgcagcattctgcgtacctatcttaccttcgtcttcacttctgccggcataccattggcggtcattcatttcaccgaacagccagtcggatttgaaacgcttgttgctcaggaagtcttttcccgtactctgggtgttcatacctgtacccagacttatatcgagaaacttcttactcggtaccgccaaggtttgtacttctatcaatcctccggtaaattcacccggcaggtcgggagtaaaggtctttgcaatagtcacattatccaccaaaccactcggtatcacatcgaaagcaaagtttctgcggttcggctccgtacttggcagggatgcaccgttcaactgcacattgttatagcgttcgcccataccacgcacatttacatacttaccgttatcaatcgtcacaccggacacacggcgaagcacttgcgccatattgttgtcactggttttcttcacaaggtcggcactgataccgtcactcatcgcaaccattgtcttttgtttggagtacagcgcattggcagatgccttgttataggtagcggttaccaccacttcattcagcatctctgtctcatcttgcaggattacatccaacggagtagttcttccccctgcaactttcacgtcgctgatgcgcattttctgatacgagatacagctcacttctaccatataggtacgtgtcggcacatctttcagtgtgaagtttcccttaatgtccgttgccgtaccggtgttgctgccggcaatgaccaccgtggctcccggtatcggaaatccgtccttatccagcacggttcccgtgatagtccctttcccggaacttttcttgtttttattatcgtcctgatatacggaatatgattccgctgatactttcttatatgaataaccggtgtttgaaagactgttggataaatccacctctactgaattgcgcttggtcgcggcaggcacactaatggctttcatattcttcccgtcgaatgcaacctctaccttatacgtcttggcgatgcggttcaaccgtagttccagtgcctctgccggatagctcgttgccttttggtcgtcactcgcatggcagatcggcgatagcagcaacattcccagtaggaacaatatgcccgttcgtaatctcattttcttattactccttttcatctttaattcgttaatattttacttaataaatcacttattttcaattagttaaactttcattttccatttccgaaaagacaaggcaatggccgtttccctttacatagggaaatttctctttcatgtatgcagctcgccaccgcataccacaggcttgtctttctttattctttcgttacgcgtgcagtcctcgtaaggtggcgcgtggatgtatatggttaccggcttacaacaatccggttgtcactgatttcatatcgcgtaccgtaaatggcacatatatttttcatcacattatttactccggattgttccggcctatacgagcaataattgattcgggcgtccgcaggtatggcatccttctctatcaccagttcccggtggaaacggttcttcacccttattttcagctcttctaccgtagcatcctccagtacgaaaccaccggtagtccatgctccgatattatcgggattcaccgtgtcatgcgaaactctgttggctgccttatcataaaccacccggtcgccacagtggaacttaccgaaagattgctcccctttcgccacttccacacatccagtgcggactgcaacctggctctccactgtcccgccgtaagctaccacattgaacgaggttccgtgtacaatggcattgatctctttcgcctttacaataaaggatttcttcttgtccttggccacctcaaagaatgcttctcctaccaggctcaccgtcctgtccttcttcccgaagttgttcgcaatgctcagattactgccgcctgcaagataaacaaccgtaccgtctgccaggtgcaacacactatcattctggcattggattacattacatgccatggcattcgtattatccgcaaatttttcattcatatagaacgaaattcccaacaccaacaggacgcttgccgcaattccggctcccgcatacttcattccacgggagaatggcaatctcttttctttcttcacctgtccggccagacagtccgttcttccttctattccttcaatgccgatcattcgtgccagcatatccaagtctcttttggtcagctcatccagttcttccggcgtagccgtttctttcttacccttactactcttaccggtaacatccatgattattttggagatgccgtcaatccgcttgagttcatcctcagtagcctttccttcttcaagtttcgagtagagagaatctatacgatcccatacacgttcttcttgttcggaagttactttctttctatttctccaaaatttaatcatatcaattatctgtttttttaatttgtcctacattcaagttctcgcatcactttgagaacccatacactaataaatcgtttgaaccccctaaaaccttcctttaaaaatcgttaaaatcaaaggatttctgcatttatccctgttttttaacttttccggactgttttccggggaagtgggcggtcaaaacttcaaagagcaacgggcaactttcaactgggtttcaatttccgttcaagtacccctacactagtaaatcatttgagacccccaaaaccttcctttaaaaatagttaattttggaagatttctgcattggtcttctttttagcctccctccgtattcagatttatagtaacgacttatatgtataaaatattacatctacaaaaatactctaaactaatttatcaaatatggttccaatacaaatttgttggcatatctccgtgcatccacccgattatcccgtcaaatattacagttctattgcatgaacattacagccatgtaaatcttaacagcccatcaatctttttaatagcttgtcataactctgaaataacctctttttacttttgggacatgaaatcctaaaaagaattatgaataaaaatctatcaaaacaactaaaggagcagcaggctgacaagattttgttacaggctatcgctgcatctgccgatgctgatgcatttttaattctttataatcggtatagccaaagactgctacagtatttttataatgtaacggacaatgcagataccgcctttgatttgagtcagaatttctggttgaacatttggcagaatgcgtcccaactcatttacgaaaacatggattcggcagaaagccttttcttcaatatggcaacaaaacgtatagccgattactaccgttccccccaatgtagcaaagaaatcccgttggatgattttcccaacctctccgacaattacgcatccccttcatcacccgaagctgactattacgccgaggagattcgcaagataaccgagaaggtactcagcaaatatcccgaattggacaaacaggttttcatctaccagaaagagttggactatcctgcccaacgaaccgccagccagttcaatatcagcattgaaagcatttacaagaaggtatccatcataatgaaggatctgcgcttccagttcaaactggccgggtattactacagcctgctcacgtgcatctgcttttgcagcctatcatagcaaacagtcacaaccaacacaaccgatatattcgcagcaaaagaaatccggagatttcttaatcgtagatttccccccactccaggctttcaaagtaatattgatattccgtattccctttccacttctttaggggaacataaacgctcaatccgcaatatttatttctgtcgataaccacatacttgaacgaagccgtagccgccgtataaacaactgtctttcccaattgtgcctccagcaaggcatcatccgtatttttcagcctgttcaccatatctttcaaatcgaagaatacctgcggcacgtcactcgtatggtacacctgcaatccgctgacatccattccagccgcatctgccagatgtccggacaacgccccatgaaccacgtcatacaacccgtccagttgtgccgcatccaccagtgtgatggttgccgaacggagcacatcatatttcatgccattataatgctgaaaataagcgttacaagcctgtttgagtccttccacaccgccgaacatatacggcaacacctttgcatacggaatacccgatgcatcgtagcttccttccgcaagcacctccgtaggcgaagctatcagataatcgctcttataccgcaatgcatacaaagcttccacactacccatcaggcacatatcaaaccagatatactcggccacatgatccggcagacccgcagccagcgcatctatctctatcatggtatccacggtcacattgcccggatgaaagtccggtccgatgtagcgtgtacgcggaaatgcctgttctcccttatccggccatacagaccgggtacggctatagccgctcggaacccaccccatggaatgtgaccacagcaccagcccgaacctttccgacggaaccagttccttcgtttcttcaatcacccgcaccagcgtttctacattggcagagttctcttcctcatagtttttcagcagcacctcttcgcctgcctgcgtaatcttgaacagacgcggcgcttcgtccatccggtccacatacaccaccgctgttcccgcactccgctttgccccggccttcagttgactgatactgtagtccacatcactatccatcgtgttatccgcaaccatatatatcagtgtggtataagaaataggtgtaggcggaagctcatcctcatcatcgtccgaacaaccggttaatgcgaaaaaaagcaggcacatccccgacaggaaaagcaggttatagcctctgaaaaatgcaataacagctggtttcataacagtattcactaattattcttcccctttattctctggatatcccagccaccgcatcacgctatccggctggttggtaatgatggcatccacccccaacgtcttcaaccgttccgtctccggcttgtcgtccaccgtccacggagccagttccatccctttggcacggaccttcccggcaatctcctccgtcagcatatcgctctccgggctatacacttgcggtacaaagtccaaccgcgccatcagttcctcaaaggtagcgttcttatcctccaccagataggacaaacggacatccggatatttctggtgcagatagttcaatgtacgcacatcaaagcattgcaccagcaaccgatcacccagcttcttgctcaacagcgctttcatgcacaagttcgcaaacgtccggtaatccggcgaataaatcccgtcctttgacggatcggactttatctcgatattgtagctcaccggagcgataccattactcttggtcaaaagttccaccgcgtcaatcaaatccgtaaccagcggtacgcagcatttcacattcttccgtcgcggatatgcaggattcggaagactgcccacatcataccgtcgcaaactgtcatacgtcattgcgtatatcttataatccttatcctccccagccggaatcggttccccttccggtgtcaatgccttaacatggttcaggtaggcatcgtgcgacaccaccaccatactgtccttcgtcacgtgcaagtcaagctccatcaccgacacaccgattgccgcagcatgcgtcattgctagtatcgtattctccggataaagagccgcaccgcccctatgcgcatgcacaacgggcagcttctccttcacgggtgcctggcatccgccaagcactgttcctgccgccagtagcaggcagacagacagccataatctacttttcataattttgtgtctctgattattaatatgacaaatgtagtgaacggatattacgatgtcactacaaacaggaaaaatacgggctaaattaaccgctttattacaagagacggacataaacacataaattccttatcgtgaagaagataaaacatttcctttatggcagctcatttgttatgttgctgtaacattacccgtcgtgagctgttaatgaatgataaatacatcacccgaccgccaagcggtttggtgtttttcagtcctcacctgctacatttgttccggcttaattgtaatagatatatattgcttgttcgtgagaacgaatgcatgtattttttagagtttaacggctggttgtacaaaacttctataaattcaataggtatagatataaaatcagcaaatccgtgaggacgtattatttgaagacacacaactgaagaagtgcgctatccccaaaagatagaggtactttttttatggttataaatatccggctctttttccccgatatagaatccgattataatcatataaataatccagtcggcacagccttccgaatcttactgtatttcagttctctttttcccatatatagccatttcctcatttttatcaccctgtcagtaacttcaccttgcgtggttcagggtgcgaagctacgtccgggtcccctaaaaatctgcaagcccgcttcgcgccctacgggttttggcgaaaatttttcaatccgtccagccgggcggttgaaaaattctcaccaaaagccttgcatattttctccccgtccgtatctgccccctgaaacgagcaaggtgaagccaccgacaaggcataaaaaaaaagtcaatgttatgaaaaagagaactgaaatacagcaagatttgaaacgaggcttcggctccgctccaaccggcattaaaaatttggtgaagtggttgtcggtcggtttcatggtctatgtggcagtacgtttcgtgtgtgcctttgtcggtggtgtagtggttggcttgggcggtgggttgcccatgttggcagttttggcggtggtgtttttcctcatccgtgccgtgtggcgcatcctttccgctttcctttccctttgcgtgctcgctcttctcatccttgttctttgcgtgatactctgacagaatattaatcatttttaaattaaatcattatgactaaagtacatttattgggagctaacaaaagttacgacagaagcgttcagaccgtttcagtcaatcaagtggtagtattggaaggctacagctatgacagctatgttgtgtatgaagtaacccgtgacaagtggggaataacctatcatcttgtcaatttgcgaacacacgagtttcacacttccgaccttatccggccattatcagagaaattcggaataggcatctattacgatgatgcgaaccccaagtttttggatccgttggaaacagccgctttactgaccaaagcgaaagagaagaaagccgaagaagaaaagaaagcgaaggaagcaagagaggaatacgaacgtatcgccaaaatcggtgcggaacgtttgcgcccccttatcccgacggatgcaaaggcggtcattatcggcacattgagagtgaacgaatgcgacagttatacggactattacgactatagtatagcaagaaccgtcattttaggcttttccaaacatacacgcaacctcttttcggaaatgcgcaagcatgccgccaattttgaggaaacggcctatttggcagaatataacgcagattacgaacaccgtgaaaattacagcatgggggacggcatgtatttgggcaggaacaagtacagcggttggacgattgagaaagagcctatctgtgaccttgaaaagttcatagaacggtatgcgcacaccgcaggggatgaagccaacctttgcatgaaagcaccgcagagggaaaacgaagcacaacagccgacagcaaccgcagacccttcaaccctcagtcttgaaatcgtggaatacagcgaaaaggcgattgccgtattcggtgacaccaagccaataaaggacgttctgaaaaacttgaacggtctgttccgtgcaaacctcacttataagggcgaaaggcgtgcagggtggatatattccaagaagcaggagctgaaagtaagggaagcactcgccacgtgcatccgcgtatgacagcatgaacggcagggcggaacaatccgccccgcctatcaaagaaccaaaaagtaacgacatgagaacggaaacaagaacatacaccctctatcggataacagagttatccgaggaagccaaggaaaaggcgcatggcgaatggttatacaatcgatacttttacggttggacttacgagaaccgccaaacccttgatgccttttgcgaacacttcggtatcgtgtgccgtaattggagatatgacgcatgtaattatagctataactaccgcagcaggcaggaagactgcatagacagcctgagcggttggcggttggtggcctatctgatgaacaaccattggaacgacttgtacacccgaaaatatttttggaacggaaggaaagggagagaaagcaggatatttgtagatacctgttgtccccttacaggctattgtattgataacgatattctcgatccgatttatcggttcttgaaatcccccaccgggaatatcacgtttgataaccttatgaacaaatgtctcgacagctttttccgtgcttgttgggatgatatggagagcacccagactttggaatacttcacggaagaaagcaacgccaacggttgggaatacctttcagacggaaaactattcaattaattatcaacatttaaaaacttaccattatgaagacgaacaaaaaagtacagaagaacagcgtacagaaatcagagaaagaaaatgcagtaaaagtaactgctttggcagttatcccgaagccgataatgttactcacaccgcaggacgtgcccacggctaccgaagtgacggcccccctcgaaacggcaaccgttcccaccgttacggaagaaacaccgcagcaggtcacgttcaagacaccgcttgcaacggccacagccgaaacagaccttgacatcaccaccatacacccaagcacggacaaccaccgcaagacgttcaatgacgcatcattgcaggaacttgcggaaagcattcgggaagtgggaatcctgcaggccattgcggtacgcccacgcacggaaggcggttatgaaatcatatacggtgaacgccgttaccgtgcctcattgcttgcaggagcaaagaccataaaggcgaccatatataataatgtgacggacgatgaagcggaagacatgtcgttaagcgagaacttgcagcgtgagcaggtacgccccactgaagaagcaaaagcgttcaagcggttgcttgaaaagggcagatatgacatgtattcactgaccgcccgtttcggacggagcgagaaatatatctatacccgattgaaactgaacgaactctatgcgcctatcggtgaactgttggacaatgaaacaatcactgtcagcgtagccgaggagataagcacctatgaacccgatatacaaaaggacgtgtacgagaagcacctcaaagaggggaacggtgaggattggacgggatatacattgaatctcttcaaaaggtactttgaaaaatactataccaccgaccttgggcaatacaagttcgacaagacggaatgcaaggcatgcgtacacaacgcagccaattacaatctctttgccgagcataacggatgcggacactgcacaaaccgcaaatgtctggaaaccaagaatgccgcccatgtggcaaaagagacggagaaacttttgaaatccgatccgaagttggttgtcgcacgcccctactacggaagccgtaacgatatggcactacagaaattggacaagaaagggcatgaaatcaaggaacttgactacaacgtatcggcaagggaatttccaaaagcccccgaagcaccgaagaaagagcagttcacccaagcgaaagagtacgaacaagcggtgcagacatttgagcgcagaaacgaggaatatgcccgaaaggtggaggaacttgaccgcatgaaggaggaaggcaggataaagacctatgtgaaggtagggcagacggaacccgaactctgctacgtggagataaacaggaaggaaaccgcccccgtcactatcgggacattgcaggagagggacaagcgtttcaaacagctttctatcgaaaagaccgttgccgacacgaaaaagattgtccgggagaacgactatcccgaaagtccgttcacgcagtacgaggacggcatgatttatttcgtcatgcttacccaactgcaaaggaagcatttttcgctttttggcatcaaggaccagcctttcgcattggacgagaaacagcggatgaaaatcgttgccaaactgacggacgcacaaaagacggtaatcaaacgggacttcatcagccacttcctttgtgagaacggccacggagacaacaacgcatccaagctgttaagagacttcgcaaacatgcactttcctgaccagtacggacttgccaaagccacccacgaggaagaatatcagaaacggcatgaacgtttggaagaaaggataaaggaaatgaagaaagcggaaaagaaagcagccaaagaagcggaaaaacagcagacggcagaaaagacggagaagaaagtcaccgccccgaaaacggagaaacccgaaagcggaaaagccgcctgaagccgaacagaaagcatgtgccggagacaacatccggcacatctttttcaccgccctccaagagaacagagggcagggccggacgaccccacccacaccgccaccgtaaaacctttaaaaatatcagcatatgaaatatataaaaatgtcccctaacgtggagtattccaccgacagggagtttttccttgaacatcaaatcctctgcatcgtgagcagggaaggtacaaagttttgcagtctggtagagaaccgtctgtttatgcgttcccaaagccgccatatcagcaagcagatgcagatgcatatcatgtgtgaaatccacaaggacatctgccgccttcgctatggcggcgaacccgtggactgacctgccacaccccacacctgaatacttcctcttaaaaaagtcgggcaatccctatgcggttgcccggcttttttctatttttgcagggttgaaccaaaaaagaaagttataagattaaagattttgaatgataacatattagaatagcttttagctgtttgttcttactctcgaaacgaccaaattcaatgcaggagaataaacgggcagagtccttgtcatacacaaatggcacggtcttaactcgtttcctgcatgggtgcttggtcgtaccggagagtagaacctgttaagttccgtgcttttttggtacataacaggaagttacggacaaggtattactcaaaaatcacaggaagatgtacaacaagaacgttgccattaccggcagtatcattgaaaagaccaccaaatacgaccaattcagggaagataaaatccgtatggaactctaccggataatccttccactttataatgaaggttatcgcacattcacctgcaatccgcattcctatatcggattattaggtgcggatacgatagtcatgctgcgtgaagcgggcaaatgcccggagataatcctttcagtagccataccggaaaccgcttttccggcagataccgacaaggtgtatcgtgccctgtatgacgacctgataaagcaggcagacaataaaaaaatacttccggaaaaagagttttttggcaatgcgcttgtcggcggtcatatcatctgttattacgatgacttttccacagaaatgcagcagatatgcgcatccggtactccctataccaatatccgtaaaatgatataggcacacattctttaccgcaggttacagcagtttctccagccgtgcaatccgtttttcggtggacggatgcgtactcatgatatattcggtgaaagtcggatgctcaccgtaaacgtcttccgtccttttcaaccggcggaggaaagaaagcaatccttcgccgcaaccatatttcactgcataggcatcacaacggtactcggcatatttattgatattcacgtcagttatccggctgatgccgtatataatccggtgaagcagtttgtaaacggcccaccataacttcgctatgagttcacctacaaggcccaaagccggaaccaatgcgaacaccatgctgccaattatcccgaatatcagagccggaataagaaatataccataaaggcagcggtaaccgaacgactccatcgagaataaaagcacctgatagacgaagtcgtaatgggagatatgccccacttcatgactgatgatgcccttcagctcctcatccgaagctgcggcgagtactccgcccgtcagtcctatcgtattgaaaccgaatgcggcagcatttacccgtgcgtcattgttacgataaagtttcagcctccggttcatacccatttctgaaagcaaccgttccagcctcatgcgatcggaactgttcaaaggacggtatccttcttttctgcgtagcacccacacatttagcggagaaatggaataaaggatgaataacagcaaaagataatacggtaacgtattgactaaatacggaatcaccccctcatcaaacagccccggtatatatgccggccatatatggcgcaagattgaaagtagcaatgcgtaaaacaccgtaataaagacaaaattcactatcgtgacataagccagcagcaacagcttgctgatgatacggaatattctgagtgttgttttcatgcgtatatgattgaactattaacttccggctaaatataaaaacaaattttgtgcaatccgaaacaattacttattcatttgttttcattaagcaaatttcataaaacaaagacgacaggtttccccaccgtctttcttgatagataatggtagcagttattcctttgccgtagtgttttctaaatcgaacgtcaccgtcatttctctttccctgccaaaattatcccggacaaagaatttcagttccgaacgtctggcgcttgtcgaacggtaaaagagggtgaatatctgcctgaccggattttccgtatccagtcccggcacctctgccagcggcctcacttcccggttcacaagttttatgccttcactatcggacacttctcccttgccttccatctggatgtaacctatttcatactccgccttttcatagtccccttcacggtcaagataaaagcgtatctccaccgtttcacccgttgcaatctgcttttgcagataccatgacgagaggctgaaatcataatcctgccggatgtctatcccgtcgttacaagaattgaaggccagcgccgcaagcagtgcacctatacatttatataatacgtttttcattttttgtttctcctttctctttttattagttaataataaggcgaacgcccaatcctatctgggtatggaagttacccgcatccgttccgaagagcgccctttcctttacctgcatcagcaggataatccggtctgtcagccagacatcgaaagccgccgtcagaccgccgccataaataaagcagtcaccgtttgtcaccgccgctccgtcaggaagcagggaggttccccagttgactgtctcgaagccgcccaaaacggaaagtccgatacggaaacagacgttccggcccttgtccgacaatacgggaataaaatagccgagttcccccgtgaactgcgctttgggtattgccttattttcgtaggtgtactcctttatctgataatccagaccatacagccagcaggtacggttacggttggtatgtgtaaaggccagcgaggtgaagtagtggcgttcgccaccactcttccatgaaaggaaatgattgactccccctgttgtaaattgtacacccgtctgtcccggcaggtcacgctgcgcgtatgcttcgcccgcaaagagcgacaacatggcaactgtcagtatgaatagtattctttgcatatacattatattatatataggttattatttcagatgcagttcactgattggttttgccgccacaaggtctgtgttctctatgcggaacgactggtgacgggcaccgcccttttcgtaaacctccaccacgagcagtttgtcatccggcagggtgagcttgggcagcacgaatataccccgcaccgtggctttcccgtccaccgttatcaggcggttgtatgtccttacaggttctatgaagttctcctgcatggccgtgcgcttggctactttcttgtccaccactttgaaacggatatagtcaatgtcgaacgatatatccgaactgttgcgcagggaagtatgcaggtacagcaggtcattattgatataaagccctttgagcagtgtctgtatgccgtacttcttgcaaccgatatgcctgatgtcccttttgttcttcttatacagcgtgtacatgatacggttcaccaccagcggtgtctccccgccgagttctttcagcttcacgaacatgcggtcgcccgcaatcccgccttcgggattgtcccgtagccagtcttccatctcaatggaaagttgcgctggttcgtccttataaaccacattaaaagaatagaaacaaccgtcggcagtgataacggagaaattcgtttccccttcaaaacctttcaccgccgccttgatgcgtactacattttccgctcccgtggccttgtccgctatgatgtcgaacgagcccaaatccacatatttcacttcggaagggaaaaggatatgtacggttttctgaaaagtcacctcaatcttatgcggtgagataatctggttggtggggaaaatctttgtttccaccggttcctgcgcctttaccgacaatacggttaaaagtatgactaatgataaaataattcttgtcttcatctgattactgttttttggatattaataaaagttgataattcgctttcacggacactttcacctcacgcatctttgtggccagatattgtgatccgccgccaagcacgccccttgtcacgtccatgacgagttgttgcgaggcactgcgtgcgaacgagatgcttgttccgaaactgcccccgatattggcggcggcttccttcatggcggtacgttctgcggtattcggaacgaaaagtccggcctgcccgtctatatcgtaagccgttagttccaccggcaggatgttcccgccgctctctatggagtttactgtgactgccatccgttgcccttcgatacgcaccgtaccatatagcggagtattggcaggtacaagcacaccacccacttgcagcggttccagcaaccggaacttcagtcatgccccggtggtcactgtctggtcttcggccacgcaggcacgtatcgtattggctccggcaagctgtccgccgcccacggcagtggcaaaaccgtaattgcggggtatcgtgtcgggtaccggaggtacggccagtgacgaaaccacattctccgtggcacgtccggcagctatggcggcaggattgccggtaccggtgcccccggcaggctgtatgttcttcacctgtccgcccgtttgtccggggaaatagcgtgccgccatctcatacgacttttccatcagttccagcgggtcttgtcctttccgttcacgttccagcttttcgttaagctcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccggtttcagcccgtccgttgtgtccggtgtcagatagcccccggccacatcctgcaaggttcttaccttctcctgcctgcgtttcttcatttcttccagttcgtaagccttctgtttgtcggccatcgtctccggtgcgatagcgtcgggtatcgtcgtattgattcctgccgtcccttccaccgtttcgggtgtgtccggtttgaagagaaaccagatgaacccggcgcaaagcagggagaggaatgtcaccacgccatagaatttcagcttgtcggcaaccttgcggtttaacttcttccccttttcggatacaggttccgctttctgcgtttctttattcttttcttctttcttatcggattgtgtcattggatacattgttttttaatggttgaatactgtccgtttggggaagcgcaatcctttggagatgctgtacctcaatcggaaatttgtctgtcccgcagaaaccgcccacgatgtaggcaaggtcgatggcggcgaagagtccgagcaggtaaaggatgataatcctttgctgccggtagctcagccgttgccaccgcctgcggagttttattatatatcggtctttctccgttctgaacgagtggaagaccttttttataccgttatctttcatactgtccgatgtccctgttttcgatgatggtaaaactctctatcagaaagccctgcggattgttgtcgctccgggttacattcctcagacggcaggtggtgacaagcgacctttcggtaacgctgctcgaacggatgatgtgctgccggctataggtcttcatctcgtagggataactgttgaagttcccctgtatgctgtccaccgtcagcgtctgcgagatgtttcccgcgatcatccggttgaagtagcctttctcctgcaagttccggtagtaaccgatggcactttcatccgaaaggtaaagggcacgctggatgttgctttcaatggcgctcttgtccggtgacagggtgaaaaacagttcgtggaaacgtctgatatgttccctcgcttccacggggcggttctgctgcacatcctgcgaaagtgccagcatcagcgattttccgctgtccagtacatagattttctgccgttgcgcctcggcaaactcgtatgcctttcaggtggcaaagaccgttaccagtacgcatactcccaggaataccattccgaacagccgtagctgccggaacgatgtctcgatgttttttaatgatttgaactccatgtcttctttctgtttttttaagtgatacgtttagaacattttcttgatgcgtccggctaccgatccaccgactgccccaccgactgccgccgcaccgtttccggccattttcccggcaccgcccaccttctgcccgtaagctcccgcaccgcctgcctgaataatccatgaggacaccgtgggaacgcagaaataaccgatgatacctataatcatgaatatacaatacacactgttggatgcgtccggtatgaacgtcgggtcctgcatctgtttgatatcctgctgcaacatcagaacctgtatgcgtgaaaggatagcgccgaacaggtcgcccacgggcagccataagtaaatacagatatagcgtgacaaccatgtggtgagcgtactctggaatccgtcatagacggccagcgcaaaagagataggccccagtatggacaggacaatcaggaagaaagtcctcagcgtgtctatcagcagcgaggctgcctgaaagaagagttccagcagttcccggaaccattgcctcaccttttcccccatgtcatacaccgccttctgcccgtacatgtttatcatcgtgtccatgtcccccagcgaccagccaagctcgtctattttcttgtcaaattcctcatcactcacaaggaaagcctttgccgggtcacgcagcatcgcttcccgttccagttcgtccttctcttcctgatacttcttcatgtcgaaagtctgctgttccaccagtgaggaagtggcactgcatacgggggaaagaatcccgttgattgtccccaataccatagtggggaagaacatgatgcaaagtcccagcacgaacggcctgaaaagcgggaacacgtcaatctcttccgcccttgaaagggactgccacactcggtaggccacatagaacagggcaccgataccggccactccctttgccacactggccatatcctcgcacagcggcatcatttcatcgtaaagcgaacgcagcaactcatgcaggttcgtccaatctattgatagtaatatcatagtttatctgtttttttaggatgaatgattaccagtaacgctggtcgtgtgtcccgtacagggcaagcacccgctgggaatcccccttcttcttgctgcgcaggtacgatatgccgatgttctttcgggtatagtaccatgtcaggttcttgtattccagcacttcgccgtatatccggttgatgatgtccagtcgttccttgtcggtcatcgagagtccggtagccgtagtcacttccttcaagtccagcagcaggttgctgctttcttcaagcaaccggttatacccgaaagcaatggccgagagttcttccacggtgaagttcgggtcgcccatcatcgtattgaaattggtcacgtaaatatcgctgatgtcacctacgagcaggatagtctgttgtaccttgcgtgccccttttacgaggtcgtgtacggatttcaaagcgtcgtagtaggcctttccctgctggtaaatctttacagtctcctgaaagttacttcacatgttctgtgccgttgtggaagtctgtacaatttcattggccgagtttacaatgccttgagcaaggttcgtagggtctatcactgcccattgtgccttgactgtcaccgaaagggacagcagtaccatgaataaaattatcattctctttttcatgcgtctatctcctttctttagtaagtaaataccgactgtcgtcatcacgggcaaacggcccgtaacagccgaacagcaacacctcgcttccgctgaaatacccgatacatccggcatccttgttcccgtgcaggaaaaggtcgtcacctttccggagcgggatattgatttcggtataactcatttctccggcgaacagcgtggccttgtatcccttgaatccgtccgtcacatggttggatttacggattgtcagcgtggagccgccttccttgttcattcagtgaccgcagatgcggtcattttccagttccttcttcatttccccgatcaggttcagcaaatccagattggtcagggtcgcatctccgagtgcttccctgcattggcttaataaatctttcttactcattgtcttctatagattaatatggttacttgttttcctgccgtttgctttcggcaagttgtttgatagccagttcgatgtttccgcccagcttttccgtaaggcgggtaagttccagtttctcagtctcttcggtggtgtagcaaaggtactcttcagccgaaacttctgttgcatataccgcactttgcgtaccgccaagccctatccagacctctttataaaggcggttcgctgcattggcaagattgatggaaagtatctggctgcgttccttgtccgtcaggccgagcaggttctgtatttggtcgaacttgttttgatacttccgctggtcgagcagtattttgcagtcactgttgttgataatcgtctctttcacaacgggggaagagataatatcatccacttcctgcgtcactacaaccgcctctccgtaaaactttctgactgttttaaaaagataacggatgtagtttgccataccttccttggcgattgccttccaagcttcctcaatcagtatcatcttgcggataccttgcaaacgtctcattttatttataaacgtctccatgataatgatggtgacaaccggaaagaggattggattatccttcacaacatccaactcaaatacaataaaccgtttgttcagtaaatccagttccttgtccgagttcagcagatacccgtattcaccgttcttataataaggttccagcacgttcagaaaaccgtccacatcaaagtccttctcccgcacgttcttgtccgccagcactttgcggtagtccttccttacaaagtcatagaacgagttgaagttcggctttatcttccggttcttctttatcttttcgatatacaggctgactgcattcgagagcgccacctcttccgaacgtcggggcggttcgtcctcccttttccaaagggtgagtatcagtgtcttgatgctgtcccgcttttcgatgtcatactggtaatcctccgtgaaaaacggattgaaagaaatcggatcattttctttgtatgtaaaataaatcccgtcatcccctccggtcttctgatgtatcaggtcacagagtcccttatatgaatttccggtgtccaccagcaggatatgcgtcccttgttcccagtactgtctcacaagatggttggtaaagaaactcttcccgctgccgctggggccgagtatgaacttgtttctgttggtcaccaccccttttttcatgggtaaatccgatatgtcgaggaagacgggctttcccgtcagcctgtccaccatgcggatgccgaagggagagagcgagttccggtaacaggtttcagccgtgaagaaacagagcgcctgcccggtaaacgtgtagaacgtctcttcggccggaaagtccgcttcatttcccggtatgcctgcccaatagagagccggaaggtcggtcgtgttatggtgcggagtacattccatcaatgccagtgcgcttcccacgtcattcttcaccctgcggagttcgtccccgttttccgcccatgcgacgatgttgcaatggcagcgcacggattgcagtccgttgctgtgcgcctcattcagatattcgtccagccactccttgttgatctggttgctgcggctgtaccgggaaagcgactgcatgttcttcgccatcttctcgaaacgggaaaggttttcgttactgtcgtctataaatatccactggttgtagatatggtcgcaggacagcatcacgcccacaggggcggcatagctaagacggcagtccgagcgatctgtcgagaggcgttcgtaccgaccgtccgtccttacctttcccggcaggtcgtcgaggtcggagagcgtatgcaggcaaagccgcttgtcaccgatacgcatctcgtcagggttcagttgcatatcctgcaacatggtagttccgtcagccgagagcgtgaggtatctctcgataatgcccggttcgttttccgttcccgtaatctcttccgtggtgagccgttccagcctgacaaggccgctgtcattaacgatactttcaaactgtcccaccgcttccatgaagcgttccaccgtttccttgtccctgatttccttcggcaccagaaaaccacggcagagcgtgttccagttgctttgctgccgggagcgttccctggtggtcttggtgaggaacaggtaacaggtgtggtgcaggtagggacgctcgttgaaatggcgttcaaaactgcgggagaggaagctgaggtcatccttccggctgtccggctcgtatttctcggtgatgaaaatatcctgtttgtgcaggattgaatagttcggcaacaccttgattgccttcgctcatgtggcgtgcatcgcctcatactctgcggaggataccgaaaacacttccggcagtgtgacccggaaagcgaccgtgatgtcggcgtccttgctgacaatgcagtcgtgttccaccgccatgatggggaacttgctttccaatgtggatgcttttaatatacttctcataatttacgattgttgtttgttaatcagacgtgtgatacgttttcgtgagaggattctccggggatgcctccgggccgcgaacagcttcatcagcccgtgacttccgtatttacggttcagcgtgaaggtcagccataccaacaccgtagccgacgataccccgaaatcgatgcagatccactgtccgatgcctgccatatacatgatgacgaacatcacgaacacggcaagcaggccggcagcgaaaataaacaggtattgtgcccgaagccccttaaattcaacctcacggcccacacctttatttatctcaaaatcagccataagttactgtcttcagtatgaatcttagaggaagaacgacctcagaatggtggcggcgactatcagaaagatacaggctccgaaccacgaactggcagttttactcgtgtcggggtcgcccgaactgaacttctggtagactttgacgccgccaacgagaccgattacggcaccgattgcataaatcaattttgttcccggatcgaaataacttgtcaccatctgggtggcctccgtaatacctgcctgcccgtttccctgggccattgccgcacttgccgccgcaacagcggcaagcatcataatcaatcttttctttttcatttatttccgtgattttttaggtgattaaaaaagccacggactgccccctttcactatccccataaggcagccgtggccgtttatggtttactgattcagggggtaagttccggccggaaatcagccggagtcataatatgctatttgcattgtcacttgatttggtggtgaaacattcttgttaattctctcttgaaagcaggatgtgaatcatcccgaatcgtaataaccgtttgttctcattgtctctattgtgtcttgtctttatcaggttatttcagatattctccgcacttgaaacccttgcggggtgtatagtcttcaaaggaggtagacttgaatagccacatccggttcgcccatcgggcaaggtcacgctcgtattgcgtaggcgtccgcttgtttgcataatcccggaaagggataacaaagggagtaatccccagttccctcagtacgttcaacctgaacaaatcctgctcaacggtcgaattgaatcctatcagcacgtagcaggttatcttgtaaggtttcacatgcctgaccatctctttcaggcggtcggtcagatccagccggggcaaatcccacgcaatatggatgttctgcttcatcttcatccggtttagatgccaggcctgttcctcattcataatcctcacatccacaccgtgcagtttaacgggttgccgggccttcatcaaataatctaccgccgatcttcactgcggattggcaaagaaattgttatccagcacctcaatccatttccctttcgggttcagctccaccggctccacggcctgaatgtatccttccttctcacggacgagacagaaggggcatttacggatgcagccccttgaaaagaactgaagggaaaaaggatattgggggtaaatggaataatccatcatccggctgttttccacagcttcgggaagcctgccggcaatatcatatcccgttccgccctttatgatttccttcgcatccagcagattgtaatcatagtcagaactaaaagtgaacactttgcttgccagcaccttatcataccgtcccgtcggttctgcccattccacccgatgcccttttgccttgtaataagctgaaaggcgcatcagcgcaaaattggggaagttatgtccgtccacatctaccagtcctatattcatacggataaaatttaatggtgaatagttcttgttgccttaccgggtgaatgccgcaggcggtctgtcatcccgaatcgtaatagccttttgtcatagccattctgttttataagtaagttaccaaaggtattgtctcttcttgattggagtgttcccttaccaggcgggaacatccatttatcaacccgaatcgaaataagtcatatacatggttttgttggtttattcagtcattaataccatagcgaatttctctctttaaggtgatacgggctgtcaacccgtatcaaaataacctcttgtcattgttacctccttttttaattggttaatctctgtccggagcagccccgcccatttgctcggcttcatccagaaatttgctgatacggctgtcgctgccattgatactttccagtatcgagcgttcaatctgcgtatctttgatatggtggatcgcccttaaaagggacaatcgtttgtctgtcggaatatccttgccgttgcagaggtcgataatcaggtcaatctcttccggccctatgccggttgcctcgcccgaatactcttcgcggatacagttcaaatcatccagttcctcgttcaactcatccgtatccacttcgtcaccgtttcctccctgtccgctatcgccatccggcttgccggaactctcatccgaagaagccctccactcttccacgcgcttgtcccggaacagttccggaatgcgctccggcggcacttgtgctaccttttgtggcgctgtatcttcgtttctgccagcaaaagtagaggcattttctttacctgcaatagttccggaaccggtgacgtttattggcggccgttgacgtatcccgtagctttttgtaacgacaagactgtccgtttcagagcgtttttggggaggtttttccatgttcctgccctctgccttttccttgacttcagccttttctttgtccttcacttccgtttttgcggtcgtgacattcctcttttcagactccggcgctaccagaacgtctttcttttccgctttccctttcgagcgcctgcgcccttttttctgttcctctttcaccggatcgaaccatccggcaacgccccgcagagcttttgccatgcggcggcgtgcctttccgaaacatatttcgccaagctgtcccttgaacaggaacttatccatgaacagataggcgaacaatagccagaacagagcgattccggcttcatagtaacctgattgtatattcataccctaaaatattttgttataactcttttgtaaataggtcttcacctcatccgcatgtttctcgaaatgctccttcaatacattgtctatgtagtttcctaccgtcaactgccgttttccggcaatgcccacgatgactgatattttctggtgcagttccttgtctatatataccccctgtctgccttcacatttataaggggtgaggaatctgcgtataaagtcagccagagccgtgcgaatcgttttcggtgacgttttttccgtaaccacttccgaacggtcggcaccacctgcatcggaaacatccctgactgtttcatttgcagtgccatccgcttttcctttctcatcggataaagcggtttctctattttcgccattacctccgccggttgaaggtacagatgataaaggaggctccgaaggaacccctgccatcaggctgcgcaggtacgcttcatccaccggattttgtccgcttgttttctttgccatgactattcggttttaagtacagatatgatttcatccataaacgtatcgaagccgcactctttggtgaatgccgcatcgggagagaacagcgtactccggtaaacggggccgcccatagcggacaagtccttggtaaagttactgcgcacgggaatacgtgttttgagacaatccagccctaacagggaaaaaccttgctgatacacatcatacaatgtcgtgcgttccctgcggtcaaccatgttccagaatagatgaagacctttcagtgcggacacgccggtctttatcagccggtcattaatggtggtggcaaagttcagcgtgctttccagcacaagacggtctgcctttatcggcacgaacagataatcgagcgcactaattgcagcgataaccccgtcgctacccatagttccgggcaggtcgaacagtaccatgtcataatgtatgtccgatttcccttcaaatctccttcagtcagtcatacaatccggcggggtacttccaatgaccggataagcctttttcttcaaccgcccggtctgctccaccaagaggttctgataaacgggtgtggtcttcaccacttccatatcccgctttttctgtttcataatagaatgttgcggatagtcgcaatccactaccgctacgctgagaccttttacataatgcagtcatgatgccgcataaatcgtaaacgtcgatttacctacgccccctttctgggaagcgaacgaaatgaataccgtttcctttcttttttccatcgttgcctaatttaagtgaataattttatttataattcagcagatagacatctatccacttatccgttcagtcatttcactatccgtttagctttatacttacatagctatgcaattatatagctatttatctattcagctatgtagctacatagctatctggctgtctatctaagtatttagctaatagtatatttacctctccatttatccgaatatacacttgcctgtctatacatctttgtatatagttgtgcaagtaaatagatagccttatgaatgcttatctgaaaacttgcttaattaaatgcctgtttagtcagaaagctattcggatagttatcctgataactacctttttatctatccaaataagtaactgaatagctatccggctgcaaataaacctcaaaaagagcatccgtgacataaccgtggtttcaaagtcatttattggcagctgttggcgtaacgcctgataatacccataccgaaaaaactatctacctttgtcgccgggagagcgcagcccgttctcgaaaagagaacgttaaacaaatcctttagacctttaatccggcacagccggattttaatatgcgtcagcatatagcaaggtgtactttgaggccctcacttgaagttcaggccctcaaagtctcgcccgaaaggtctttcgggggtggcggttctcccaagtcgaaccttctaaaatattcatgtcatgaagaaaaggatgcttgtaagcaatgaaaaggggcacaaggtgctcgcagacccacgggtgcatcgccactcagtgcggttgaacagtgaggaaaatgaaaaattcctcacgatgtttgaacaatcgggtatgaagaacaaggccgaatttatcttcgcccgtatcttcggctgagaattcaaggtggtgaagattgacaaggaagcgcaggaatattatgcccagctcaccgctttctatcagcagttccgccgtatcgggaataactataaccaatgtgtaaagactatccataccatttacggagagaagaaatcgcttgcatttctctacaaacttgccgaagaaacccgtaaactggaagaagtatgcaggcaggttatcgaactgacaaagcggtacgagaaggagtatctcactaaaaaggaataacgtcatggtgccgaatatcacatccggcagttcattctatggagtgattgcctataataagataaaggtggacgacggtacggcaaaggtattgtgacacccgaaaatagcggcggacacttccggcaatgtgccgattgaaaactgcgtgcaggctttcgagccttatatcgcactcaactcgcacgtcaggaaaccggttatccacatctcattgaatccttccccaaaagacattctttcaaaagaacaaatgaccgtattggcgcaggagttcatggaaaagttcggttacgggaaccagccctatatcgtatggctacacgaagacatagaccgtaaacacatgcacatcatttcggtacgtatcaacgagaagggagaaaaaatagaccacaaccgggaagccatccgggcacagaatatctgtcgggatatggaagtgaagtacggccttcattccacactcggagaacacagtgaaagggaattactatccttgcaaaaagtggattatccgaaaggtgacgtgaaagcgcaggtgaagcatactgcccgtactttgctggaatgttacaactgccattcgcttgccgaatacaacacccttctgaacttgtataacgtaaccgtttatgaagtcaggggaagcgtggacgggaaggaatactacggcatcatgtacggagctttggatgatgacggacagcaggcaggcacgcctttcaagtccagcaagttcggaaaggtattcggttatgaagccctgcaaaagaagtttgccgccaccgccgaaaaggtgaaaaggaacagccttgccgaaagggcacggcaggaaatagtcaaagccatgcaggacataagtacgaaagaagcgtttgcccgcaggctgaaagatgcggatatagaggtggtttaccgtatcaatcccgaaggacgcctgtacggtatcactttcatagaccataccaaccggacagtgttcaacggctcgcgtttgggcaaggccttttcagccaatgtattcaacgaactgttcaataatccggatgcggaccgtacaaagctgataccgccaccggagcaggatacgccccggcaggcacgggaaacggatgcggaagaaagacaggaaagggaggaataccggcagcaggaaaatcgaggcaactatcagagtgaaccgtccggcagtctgattgatacgtccgcactcggtgccattgacattttctccgtactcatggaagatgaccatacgcacgagtacatcgatccggccttccgcttcgggcacaagaaaaagaagaagcgcaggcgcaggttataatataataatgtatagaagaagtctaattttaatagttacaattatgcagaatgaagatgatttaagaggtcttgccaaagtcacggactttatgcgggccatcagttttttatttttggcgatacacatctattggttttgttacggctggctccacgaaatgggctgaacgctcgatatagtggataagatactgtccaatttccaacgtactaccggactattttcatctttgctttacaccaaactgttttgtgtcctcttcctcagtctgtcctgcatgggcaacaagggagtgaagaagcatgaaatcacatgaaggcagattatcattgcggccatagcgggtgcaatactctttttcctgaactggtggctactgtccattgacgcatcatccggtgtatgtgcggtactttataccacaacattggtcggtggctttttctgtctgttggcatcgggattgtggataagccgtctgttgaagaacaatttgctggaggacgttttcaataccgaaaatgaatcattcatgcaggaaacccgccttatggaaaacgagtattccattaacctgccgactagattctggtacaggaaaaaggaatggaaaggctggataaacgtggtgaatccttttcgggccagcatgattttaggtacaccgggtagcgggaaatcgtatgccgtggtcaataattacataaagcaggcaatcgagaagtcctatgcactttacatatacgactttaaatttgatgacttgtccgttatcgcttataaccacttgattaagtacagacaccgctataagataccgcctaagttctacgtgataaatttcgataacccacgcaagagccatcgctgtaacccgctggcaccggaactgatgacggatatttcagacgcttacgagtcgtcgtacaccataatgcttaacctcaataagtcgtgggtgcagaagcagggggacttcttcgtggaatccccgattgtcctgtttacggcgataatatggtttttgaaaatctatgaaggcggcaagtattgtacgttccctcatgccatagaattgcttaataaaagatatgaagacgtctttactatcctgacaagttatcctgatttggaaaactatcttagtccgttcattgacgcatggaaaggcggagcgagcgaacagctccagggccagattgcaagtgctaaaatcccgttatccagactgataagtccgcaactctattgggtaatgtccggcagtgattttacactggatattaataatccgaaagaacctaaagttctttgtgtaggtaacaatcccgatagaatttccatttatggtgcggcgttaggactttataactcccgtattgtaaagctgataaacaagaagaaacaactgaaaagttgtgtgattattgacgagttaccaaccatcttctttaaagggttggataaccttatagcaacagcacgaagcaacaaagtggcagtcgtattgggtttccaagactttagtcaactgaaacgtgactatggtgacaaggaggccgccgttatcatgtcaactgtgggtaatgtcttcagtggtcaggtagtaggtgagacggcaaaaacactatcagagcgatttggaaaaatcctgcaaaaacgggagtctatgagcatcaaccgtaacgatacatccacttccatcagcacgcaactggacagcctgatacctgccagcaaaatcagtacactctcacagggtatgtttgtgggtgctgtaacggataatttcggagaaacgatagaccagaaagttttccatgcgcaaatagtagtggataatgatgcggtacagaaggaaacaacctcctatcaacccattcctgaaatcagcagttttctggacgagaacggtaacgatacaatggagcagcagatacaggccaactaccagcaaatcaagcaggatattgtggaacttgtagagaacgagttaatccgcatagagaatgatccggaactcaaacacctgttaggtggtgatgaaggtgcacgggcacaagcatagccgtttgtcataacagtatgtttcccacggtttttgcggcaatcccggaagctgtgcaggctccacttccgtagattgccgcaaaaaccgttcttcaaactaaattcctgcgtatatatcattcaacatactattcatatagtagcctttcatatctatttccaaatatcataatttcttgtttaaaaagaaaaagatttttgactatgatttccttgtgtctattcttatatggagaaagaattatcttttgtatttctttagttgtaagaacttttattaaagagaccatttcctcaactgcccgcatacaatagcgaaagcattgttgtgcttttacgtgtatgctatatacattaaaataatgagtaacgaaaataataatctgtcattatatggttggagtgataatctattccggcaaaaacaaatctcacaatataaagatatgtctcatggacgaatcatcgtgacacataaaacctgttatgaagtagttgcagaggatggtgtatatttgtgcgagttaacaggaaatatgatttatggcagagtgcctgatgaatatccttgtacgggcgattgggtgatttttcagccattcgatgcaaacaaagggattatagttgatatattgccccgtgaacgggcgttgtatcgaaagaagaacggaagggtagccgaccggcaggccattgcttcttacgtcgataaggcatttattgtgcaaagccttgatgataatttcaatgttcgcagggcggaacgtttcattgcccaggtaatggaagaaaaaatcaaaccggtattagtgctcaataaagccgatttaggttgtgacagacagaaaatagatgaagcgatcaaacacattgcccgtcagtttcctgtatttatcacaagtattcgtcaacctcaaacgattcttcggttgcgggaatccataacaaaaggcgaaacagttgtgtttgtcggctcttcgggtgtcggcaagagttctttggtgaatgccctttgcgggaaatcggtattgaatacttctgatataagcctgtctacagggaaggggcggcatacttcgactcgtcgggaaatggtattgatggatggctcaggtgttttaatcgacactccgggtgttcgggaatttggtttggcgattgacaatcccgattcgctcaccgaaatgtttgaaatatccgactatgcggaatcatgccgtttcagcgattgtaaacatatcgacgagccgggttgtgctgttttagaggcggtacataatggtacgttagatcataaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagaactattgaagcagggaatgccggtactttatcagacaaggtgatactgtatgacggcttctctgcttcttattgtttggtaagagtttacggcaactattctcttgcttttagagtaaaggcatttcaactcttgtgacatgttcctcttcgggtacatccggattgctgtaataatactctattgatgttcccgaggccttgtagccatttgtttttatccattcggtcatctcattgtacagctgtgccagttcattgtaatttcctctgtgcagacatacgactattcttctggcggggaggatgacagattgtattttttcgtcaccttgtaaaggtttcgaagatttcagtccgataatcatttttatacgatcttcggtcaggctttcgaagtcggggtactctacgaaggggatatccgtggttacttctccctgtttcttgaataaagagtctattcttacaaaattctctccgatagcctgtgacatacctttcatgtaggtttgtacttcaatagccaaagcgggctgttccggctgctgtaaaagcatgatttctgatatctttgccatagattctgttttaatggtgattatttccgtatgaccggtatatatatttctgttagtaattccgacgtttccgtggtggacggatgattcatatacatctcaaagctgaatgtgctttggggatggtatttacttttcggaaaccattcctcataaatgctcctgtacactttgtgtaaagaagaatagctccccgtatgtctgaacacggcatatcgccctccgggaatttgcatgattcccggtaccggtctcgctttagtatcatcgcgaagggtgatgcctagatagaaccggcacttctccgtaggcgtaatcgacggatcgtccatgctaaggctgataaacttgtcatatcgtgggtctgcttcatactgttcggcatgatgcagtagtttattccaaagtaatctgtattttagtttgtttttatacgcttcacccacttcgatgcagaatatctttatcgggctgatcacttttatctccggttttatgtttgttgccggattttcaccgttcggtctgtgcttctctctgtattgagaagttgatataccaaaatgtttcttaaaagctttggcgatactgtatttagtctgataactcgttttctatgatttgctttagcgtatagtccgtagagatcagcagatgtgcaacgtgttccatgcgcaaacgctgtatgtaactgccgatattctctccggtagcggtgcggaacactcttctgaaatgaaatttggacagtccgctcatcgaactcagcgtgtcggtattcagtacctccgtcagatgaccgttgatgtacactattatgttctgaatcatcttatgatgaaggctgcttgtctcttgcttttgccgccatctgttcagtgtgggaaggcgtttgtccagtatctccctcagctctttcggagaatagtccgtgtctgcgtattcattatatttatctgtatattttatccagatgtcgatcatttcccacatggatatatcaacaatgtatttcccatccttcaggcagtaataacaaaactcatcactcctcgaaccgtcagagttggtgcctaaatattcctccacgtcgaagcggagcggcattccgcagctttggcaatatcttttatttatttctgattcaaccatttgactaatcttgcattctttgcaaaaataagctattttttcagtaaacagttgtccggaatagccatctttttattaacaaatgttcatttccgctatttcttaaagttgtatctttgccgcgcttttataatatataaggtaaagatggaaacaataactggaaaaagaagtttatcattctatgagccgattgtttggtgtaggtctgtttgtcatcgattcgatattggatatgttttgggctttatgtagagtcttatatctatgttctgtgtatattaataaaaaaacctctgataatcaatgattatcagaggttttttactccgtgatccagctggggctcgaacccaggaccccaacattaaaagtgttgtgctctacctgctgagctactgaatcaatcctttatgctttctttcgaattgcgggtgcaaaggtagaacatttttttagaactccaaagcatttcaaacatttttcttatctttgtgccattatcaacaatatacaatcattaatatatggctgacgataaaaaaatcatcttctcaatggtgggagtgagcaaagctttccaaccaaataaaaatgtactgaaagacatttacctgtcgttcttctatggagcgaagattggtattatcggtctgaacggttccggtaaatctaccttattgaagattatcgcggggctggagaaatcctatcagggagaagtggtcttctctccgggatattctgtgggctatttggcacaagaaccttatctggacgacacaaagacagtaaaagaagtagtaatggaaggtgtgcaaccgatcgttgacgcactggcagaatacgaagaaatcaatcagaaattcggtttgcccgagtattatgaagatcaggacaagatggatatacttttcgcccgtcagggagaattgcaagatatcatcgacgcaactgatgcatggaatctggacagtaaactggaacgtgcgatggatgcgctccgttgtccgcccgaagatcagccggtggtgaatctctccggaggtgaacgccgtcgtgtcgctctttgccgtttgttgttgcagaaaccggacatcctgttgctcgatgagcctaccaaccacttggatgctgaatctatcgactggctggaacaacatttgcagcaatacgaaggtacagttatcgccgtaactcacgaccgttacttccttgatcacgttgccggatggattctcgaactcgaccgtggcgaaggtatcccttggaagggaaactactcatcctggctggaacagaagaccaaacggatggaaatggaagaaaagaccgccagcaagcgtcgtaaaacactggaacgtgagttggaatgggtgcgcatggctccgaaagctcgtcaggcgaaaggaaaagcccgtcttaattcatacgacaagttgctgaatgaagacttgaaggagaaagaagagaagctggaaatctttatcccgaatggtccccgtctgggtaataaggtaatcgaggcaaaacacgtagcgaaggcatacggcgacaaactgctgttcgatgatctgaactttatgcttcctcctaacggtattgtcggtgtcatcggtcctaacggtgcaggaaaaacaactcttttccgtctgattatgggattggaaacggtagataaaggtgagtttgaagtaggagagaccgtaaaggtatcctatgtagaccagcagcataaagacattgacccgaacaagagcgtctatcaggtaatctccggtggtaatgatttgatccgtatgggtggacgtgatatcaatgcacgtgcgtacctgtcccgtttcaactttgccggtgccgatcaggaaaaactttgtggtgttctttccggtggtgaaagaaaccgtctgcatctggcgatcgctctgaaagaagaaggtaacgttctgctgctcgatgagccgaccaatgacattgacgtgaacacccttcgtgctttggaggaaggtttggaagactttgcagggtgtgcggtagtcatctctcacgaccgttggttccttgatcgtatctgtacgcatatcctcgcttttgaaggagactctaatgtattctactttgaaggttcctattcagaatatgaggaaaacaaattgaagcgtctaggcaatgaagagccgaagcgtgttcgttatagaaacctaatgactgactagtatttgctgacagattacaagttaaatctcacttaatatacgaaagtgaaaggctctgcaaacattgcagggcctttattgttttcgaaagcaataaaatgtttatctctcttaaaagaatgtagcataattgtcatctaagtctaaataatattaattatctttgtgcacagtttcaatgaaacaaacaattagtattaactaataaattacattatgttgaagagaatgcggtcttttttagtggtcgtaatgttactgattactgctacgatgagtgcgcaagttaccacagcaagtatgagtggtaaagtaacagcacaagatgaacctattattggagcaacgatcgttgctattcacgagccctccggtacccgctatggtacagtgaccaatgtcagtgggcaattcaatctgcaaggtatgcgtacaggcggtccttacaaagtcgaaatcacctatgtcggctatcagtcagccatttacaagggcatccagttgtcattaggagaaaactacgtattgaatgtttctttgaaagaaagttcagagttgttggatgaagtagtagtaacagcaccaaaaactatcgaaaaaataggtactgttactaatgtaagtgaacgtcagatgaacactttacctactattaacagaagtataacagatttcacaaagctctctccttatgcaggtggaagcagttcttttgcggggcgtgatggacgttataacaatataacgattgatggtgcttcgtttaataatagtttcggattaagttctaataatttacctggaggagattctcaacccatatctttagatgcaatcgatgagattactgtaaatgtctctccttacgatgttaaatattccaacttcacaggtgcttctattaatgctgtaacaaaaagtggaacaaactcattttcgggtactgcatatacctatcataaaccaagaggatttgcagggagctctattgacggtgaggatattcttaaagcaaaagaatacaactctcattcatatggtgtaacttttggaggtccaatcattaagaataagcttttcttcttcttgaatgctgaaattgaaaataaggaaactccgggggtaacttggcttcctaatcaagatcaaaatggaacaggggatagcggaaaacgtatctcacgtacttgggtgggtgatatgcgtactatcagtgactttgttaaaactaaatatgattatgaccccggacagtatgagaacttcaataatttccaaagtgataattggaagttaatggctcgtattgattggaatatacatcagaaccataagttgacagtgcgttttaattctgtttcctcagaagatgacagagaagtaagcgctaagtccactattataactagtactaattctaatcgttatggtttggatgccttttcttttggtaattcaaactataagatgaaaaacgtagtaacatcgataacaggcgagttaaatagtcgtttctcgaataatgttcagaataaactgttagccacatatactcatattagtgatacacgcgagcagaaaggctctgattttccttttgtcgatatatataaggacggaaagcaatatataactttaggtacagaagtgtttactcctaataatcaggttatcaataatgtatttagtcttgttgataatgtgagtatatcattaggaaaacatgaattgcttgctggcgtttcttttgaacgccaatattttaaaaactcttatttgagaggcccttacggatattatcgttatgattcaatggatgattttatgcagggaaaagtacctaccatttatggtattacatatgggtataatggtaatgatgctccaggttctgagttgacattcggaatggctggtgtgtatgcccaagacgtatggtctcttactcctaattttcgtttgacttatggcttacgtctggatatgccaatatatatgaattcattggattctaacaagtcaatagaggaattagcttttgtaaataatactcatgtcgatatttctaagtggccgaagacgcaagtcttgttttcgccaagagtcggttttaattgggatgtaaaaggtgatcgctccgtaattgtatcaggaggtacaggaatctttactggattgttaccttttgtatggttcactaatcaaccaagtaattcgggcttataccaaaatatggtagagtataatacacaaaaaaatccgggctctttacctgctgactttggttttaatcctaattatagagaaactctgcagaaatatcccagtttatttccttctacaccttcagagcaagcacctgatgttatagcatatgtagatcctaagtttaagatgccgcaagtttggcgtagtaatttgaatgtggatattcaactgccgtatgattttatgttatctgttggagcaatgtatacaagagatatttataatgttgcgcagatcaatatgaatgaggctgagcctacgggtgtgtataatgaacaaccggatcgtatttattgggcttcaaaaaaatacgagtataatgattatactaatggtaagaatgtagtagtaaaactttctaatggagaagataaaggatatcaatattcttttaatgctattttgacaaagaaatacgattttggttttacagggtctatcggctatacttatacaatggctaaagatctgactgcaaatcctgggtcagcacctaattcagcatggcaaaataatgtggcagtaaattcattgaatgatcctggagtatcttattctttattttctacgccccatcgtattattgctaatgcttcttatgaaattaattatgctaaatgcttaaagacaacattctcgttattttattcaggatatcatacaggacgttattcctatacatattataatgatatgaatggtgatggcaattattcggatttaatatacgtgcctaactctcaggatgaaatgacctttgttgatattacagataaaagtggtgctattacttattctgctgtagatcaagctaaagatttttgggattttgtgaacaatgattcttatcttaaagatcgtaagggaaaatatgtggaacgtaatggatctttaacaccttggattaatcgctttgattttaaaattgctcaggatttttatgcaactttaggtgggcgtaaatatggaatacaggttagccttgatatgctgaatgtaggaaatatgattaattcaaaatggggagcatatcaatcttgtggtctcaagagttatgacaatgtacagttattaaaaactgctagcaaagttggtgaacccttgacttaccagataaatgctaattcacgtgaagcttttaaagaaagatcatcatggcaatataccaataccattggtagtgcatggtctatgcaattaggagtaaaagttactttctaatacaagttttaaaattaaaaagaaggattttattttaatgggaagccagttaattcataatgagttaactggcttttttgtagcctttctatatagtgatatacagcgtaaggtttataacctcattctcatcaccaccggattatgatcactatactccaaatccggagagaagtaatctaccccttgaaactcagacgaatggaggatatagtcgattctcagcagatgcttgaaatatcggaaagtgtacatatacccatgtccgcaggtctgaaagccatcattcatcttttctccttttacagtttgatatacatatgaagaagggagagagttgaagtcaccgcataccagggtgggatagggagaatcggaaatcaattgattgatatgttcagcttgtgcggcacgtttcttgaagttctcatgcagaccatcggcaagggtgagagcggcacgttccgcacggtcggtatcgtctgcacgaagttctttttccagtttgcgcttgttgcggctgacttccgtagtctgcagatgattgttgaacagacggattgtttggccgttaatgtcgatatcacaccacaggctgcagttgttggaatttgggtaggtgacgagctgcttctccttgataggataacggctgaacacagccagttgcaaaagactctctccggcaggagaagaaggtacatagtaatacggccattcggaaagaacggtgcgaagactgtcagtaccaaattcatgattgatcccaaactcttgaaaacagaagatatctacaccgagctccttcatgtaagcagcgatttccttgcatgagaaacctgtgtgctcgtgattaaagctgttaacgttataggtggcaatagtcagtgctgattcggtggccctttcgtttttcttcagagattcagtattcggttgggaagccgaatcgaaaagcggggactggaggacacgggtcagataccccaaatttcccagtatggcgattaaaggaatgaaaacccagcatcgccagcgaaccgtccaatagatggcagagacgacattagccagcaaaagcatcggcagaaccaatccgataaagggcatcagcttaaagccgcccggcgaagcatctccggcgaaggctccggctaatgtgaaacctgccagaatgctcgtcagcaggatagacaggtagtaaagtaatctatataaggctttcattttatggtaaccatttattaatcatatccttgagcttcgcttgagagatcggcttggcgatgaagtcgctgcatccggcatccattgcagctatctgatcctgttgataagcataagcactttgtgcgataatgggcacagtatgagaaagctcacgaatgatcttcgtagcctccagaccgtcgagattaggcattttgatatccatcagaataaggtcaggcttcgcttcatcgtatgaggtaacggcctccataccgtcccgtgcacgtataagcctgtactttcttccaagaatagccttcagcaagtcgaagttactgtcctcatcttccgctatcagaatagtccgctggcttggagaggcattggcggaaatactaccggaactatcatcgtccgtacttccggaagtcttttcggaatcctccttgacagacgtttctgctggcgtctccgtagaagccgggtcaatcttcatcgaacccgtgccggtcggattttcatttgcattcccttcctgccgtttttcctccttcgtattttcggtcgattgttccgactcgtaaggcagggtgaacgtgaaagtcgtcccttgacctaccaccgaagaaacggagatttcacctcccagccgttcgacaattgttttacagatagacagtccgagccccgtcccctgcgcatagttgttcaacttggcgaaacgttcgaacacacgtcctatcttctccggttcgatgcccgtaccggtatcagtcacgtggaaaacgatctgattacctaccagtttatatccgtaactaatgctgcctgctttcgtgaatttgaatgcgttacctatcagattcgagaacacctggaacacccggttcttgtcagtctctatcaccagtccgttttcggatggctcgtagatcagttgtaccccttgcggcgtgcgaaatacgtgagcgtcatgtacttctttacacagactgttgatatttatcggtgcgctggtgaactcgataatgcccgattcgatcttcgaaagatcaagaatttcgttgatcagttgcagcagacgttcgttgttggcttcgacgatctcataaaatgttttacgttcttccttattttcactttcggctatcagatgtgagaagccgacgatggcattcagaggtgtgcgtatttcatgactcatgttggcgaggaaagcagacttcagtttgtccgacatttcggctttctctttggatgtctgaagttcccgtttgattttttccagctccgtgatgtcccattcgatgctgacgatgatgggggaggaaagttcgtctccgtccacccgtattttccgtttgtcgaggatgatctcgtttccgtttttgtctttcccttcggttgtccagtgcagtccccgtccggtggtggcaactagtgtatcttcctcccttttcttttctgccacttcggggggatagtagtcgaagtcattcttgccgatagattcgccgatgcacagattccggttgtacgattcccggttgcggtagatatatcggaaatcgttgttgatctccttgacgacaattccggcggggaggttgtcgatggtagtatccatgatcaggttgagtcgtttgatttgcgcttcgtagtgcagtcgctcggatatgtcgtgggagaatgaccagtaactttcttcaccggagtcattggtgacgttgtacatgattccctcgtaagccaatatattcttgctgaccttcgaaggatgatgggcgacgaaacttctgcttcctccgtgcaggatatccttgcagcgttcatgccagtcttcctgcgtgttcatatcgccggcgatttcatagattttcagtttgccgatctcctcactttccgggatgccgtggttgtggaggaactggcggttggcgaagatcagcgtaccgtcctctttggcggcgaagatgctctcctttgcgttgttgatggcgtgcgtcagcgtgttgatgtcgtttctgcgacgctgtatgtcggtgatgttctggatgtaaccttcgatgttgcagctgccgttcggtagttcgtctcgcagataagcctgaaggcgcatatagtaaatctctccggcgacacggacccgatagctgatactttcttcgttgagtccttcctcattcttccggcaccagctggtgaagctcaggcggtcttcttcgacgataaattcctgatatttctccagagagatacttctggaagattcctcgcacaatactccggtgtagcccatgtaatggaagacattgtcgcgggtgttgtacatccactgtccgatctgagccactttctgtatctccctcagatttcggtttacctgttccagctggcgtttcacgttgcttcgctgggtgatgtcccgatattggcagagcaccatgtcatcgtaaggatacatgatacacttgaaataataggtattatcctccagttccagcttgtagttcttgctgatgcttcgctgttcccgaagcacggtctggaaggtgctgtaaaccttctcacgggtatgctcgggcatacgttcgaatatattttttcctaaaagcctctcttcttgtaaaaaccataaattgctatgaatatcaatatcaatgcaaatgccatttctatcgactaatagcatggtgtcggcggtcaacttcagtattctttgcgcattatctgcctcatgtaatgttctgttcatgcttgtccgattagatttataagattctgtttcatgcaaagatagcaaaatatttgattctctgttcttatttttcggcacgttttgctttttcccaggcgccgcttccttttttcttttcagatagccgattcctttgagcacattcacgttcatgaataagaaataatagggaataaacagtactttattctttatttgtctggtagagaggtaatatccccagtatcccattccgtagaaaagaatctgtaaccccagcagggtgccataaaacaggggagattcgcccaatagcaaaacgactatattcagtggcaacagcgcaaacagcaggaatggagtgacagaccagcgcaatacccggtgcgacgtgtactgaaaactcaggattccgtaatggaaaggattcagcaacgggcgcagacgccagatcgactgtaaccctccggcagcgatgcgcacttttcgtttttcctcttcacccatatctgccgatccgctttcgatggcgtaggcattggtgcagtaggcgatggtgtatcctttcatggcgatgcggagagagaggatgaagtcgtcgagcaacgtatccggttccatcggttcgaagagttcgcggcggacggcaaacagttctccggcagcgcctacagccgagtagaggcgggagtcgagcgctttcagtgtcgattcgtatttccagtagatgccttcgcctccggcggctgctccgtctttcgtctgtacggctatgcgtttttctcctgccacgcagcctactttcgggttttgaaaagccagtacgatttcatggattgcctcgctgttgaccatcgtgttggcgtccgtaaagacgacaagcggggtccggacgagtgtcattcctcgtgtcatggcggctgtctttccctgccgtttcggctggaagtagacggttgcttttccgttccagcgagtttggagacggtcgtttgtgccgtcatcgcttccgtccgtcacccagacgatgcggagtttgtccgcagggtagtccagggcgaggctgttctccatcttttcgtccaccacgtcttcttcgttgaaggcggtgatgaagagggttacttccggcaggtcactgtccggtggcagcacccgtttcacgggtttcacgaaaagctctttcagcttgacgagggcgtagaggacgataccgtagcccagataggtgtagaacaccatgaacagggcggaccagaagatgatttcgaggatgagggtttcgttcatagctatattctcgtttaatagatgtttgttgatttacttattgaagtcgtttttttagtgcctcttttttagccgattctttcagtatgtttacaaagtagagggcgtctgctttgttggaagcatcggaaggattggcctcatatcgttttacgaaattctcggcgtgttcaaacaggtatttccgacagtcgatattgagcatgataccgtctttgtagtcagcataagatagtccggtcaatgcatcatttccttcgatagaaacaatgtcatacatgctaattcccggcaaattgatagtggtagaaggatagtagaagaacttttctcccggtaaatttactgttaatttgaaagaacttgcgtctatttgtgctatactaatatggctgtttaaacgataatagttatattcataatattcttcctggcttggaaaccataacgaatcatccccatctttaccataattactatttaaccataataaaaagtcgatccaattgttgtccgtaccatgaacacctatgcagattgctttacgttcttctttgggtaattttagcaggtcagtaatctgttgtttaaaatatgctggtgaatcgttaaactcccgttctatcagagatttttgtaaagtttcagacacttgatacggatatagggtaattgctcctgcttgtgcggtcatcgtttgaatttccggacattgaagagcagcagttacgtatgttttatttccattgggttcagcaagaaatttacatccccttcctgtgagtttctctacaataatgttttgggcaatatcaaaatgttccaatatttgtattggatcattagcatcttttgtcattacatcatggagggcaatgcctgttccatagttcaacatctctcgtatgttatcccatataagtccggatttcatataaaaacgataatagtttgcagtaaaccccggcagtacgtttgtttcagcatccatccatttttcttcaggggcaagagtggtagtaatagcaaaccgaacttcatttcctgctccgtctgtacatcccaaagattggttggcggaaataatagtagggggaagatcccctttttgcaaatgtttgatgtcaaaatataattgatgtttcatattctgatcagtgggagttggagtaggataaggtattgaacttgagatcggtttaccgtttattgcagcccacgtacggcaaaaagcagcctgcatgcagtcgtcttgtgttagcatcaacatccatgtcttattgtattttaaatgagggatttcgacattaatatctttggtctgtatttctttttttgtgtggataatgatttctgctgtaacgtttgctgtttctttgtcgaaaggatacatatagacgggagtagaatctgtatctttttcgttattgtcttgtcctgtatttctattctcatcgtatagattcatttttcttatacaggaagtataggtgaaaagacaagctgttactaagatgatatttactatatattttgccatatccataatgattttgatgagaccttatttgatgagattagagtctttatctttgtatgccgtctttttgataaagagtccggtgatttctttcagtgctttgattacccgtatccatatattatcaatcagtgatccttcagaatttagggttccattacttgtaagcactcgtgctttgcgacttgtaataaatacgatttttccatacggtttcatagctaatgctaacgaaccgtcttctccgcggataatatctgtacgaaatccaaaccgacgtcctatttccgtattaaaactgaaagccatacctcgcacacagagttcaggacgctggatggcttgtaagcggaggtatatatcgcgcaggccttcgtagcaccatagtccgaatcgggaatgtctttcgtcaaccataaaactccataaactgaatgtacatgcaaccttcggattcattagatattttacatgcgtttcaatgtaatgcggtggatataaagtatctgcatcaatacaaatatgatattttccttttgcatggtccaatccgcattggcgggcatatcccggacctttcttcgtttcgttataataggtaactcccaatgattttaatatttcttccgttttatccgttgaattgttgttaacggctattatttcaatggggaaatggcaatgattctcggagagtgaccagatacaacttatcagatgacgttcctcattgtgtgcaatgagtacaaccgataccagtggagaatcgttttgacgttctttgagttgtcttttgactttgcggatactatcgtcagaaatctcatcaaaagatttcccgtatacttccagataagttttataccactttaccatatgttgttctgttatttagaagaataagttaatgattcgaataagtttttccattgtggcatcacattttccggcagaaagcgttttacgttttccctggctttgtgtcccatcttgatgcgtacattttcattctcaatcagatagcagattttgtctgcaagttccttgatattttctttctccactagtagaccgtcttcatggtcttttataatattcgaaggaccatgcggacagtcaaatgagacacagggtataccacatgacattgcttctgccaaaacgagtccaaaaccttcgtatcggcttgataagacaaatatcgaactcatacagtatttttcggctatattcgatacagtgtgatgaagcagacaattattatttagttgtagttcatctattagtttggtgaacttctctttcaggtcgccttctccataaatatgtagtttccagtccggatgtctttgggcgacaatgctccaggcggggattagcatatcaaatcctttttggggcgcatatcgccctacagcaatagcattatgtgacagaatatctgtttgttttccttctacaggagtagaaataggattagggatgatgctgatattagtcagttccggccagtctttagctccttcacttgtaagtataatcactctggacagtttagacaggtttttgacaaatctgtttgcccatcttttctttatcatgttgacaatcgggcttttacgtttcagtgcttctgcgccataggcgtagcggctgacgtgaaactctccgattttcaggctaccgtctttcaatttagtgataaagttcagttcccggcgcatggttgagatagtaatgtccggtttcagttcgttcaatagattcgatagtcgttgtttaaaccgatagtagcggaacggatacttcagcactttacttactatggattgagagtagggcaggtcgaaagatactcctaagtcgatatgctttactttgggggataatggaaagtgtggtgctttacccatttgttcggatgtaatgatggtgatgtcgtatccttcaaaatgttctgcaaaataattggctttgaatgtaactatccgttctattccgccaggtgcctgtagtgagggcaggtaataggctatcttcatgatttaatagattttagcaatgatttgtttccgataaaattctccggcgtcggacacttgttttccgttggcggcttcgtttacatattttcgttccagctttactttccgtttggctcccattcgccaccattcatattctacgtccacgtgccctgcgtcaattgcctgataaccggacttgaataaatcgtaagccagtacagtagccgtaggtcctaaagcaatcaggaagagagcggttttctcgagtttttgcgcttcattcagtatttcttcgtagcggtcaaatgcgtcacggggcggacaaagaatacgtctgatgctttttacattgtcaaagaggtcgttgcctacccccaaacggcttttttcgccttcaatgaatacgacatccctgtctttccagatagctttcatctggtgaaaccaccgtgggcagtcttctttggaagcgaagtccatgtagggacgggtgatgaatgtattgtagtatagcctgtcgggcaacagcaagcggtcccaccaactgccatacagaaagaagtgagttctccagaatcggcgtgctttgcggttatagcgataaatgttttcgaaagtatcggagatacaaaccaaatgtccttcttcatggcttgtcaatacttccttgagacgctgagccaagagtacatttcctttttggaatcctatttccttgtccgggttggtaagcagcatctcaccatcgccgaaacggctcacggaacattggtcttctatgattatccgaatggtctcatcaatggaagctacctgcggagttattttctgatggcatctgagagccatgtaccagaaattgtaccattctacagtaatgccataacgcaatttatagcggatagcattgatcagtggctgtatattcatagtgatatagttttattcaaaggtttcattaataacaatttgcatctgggctttccatgaaagtgattgctctatagacatccgtatttggagcggcgttgttttcaatgattgataaaagcgaattactttttcgatgtcaaggggcgaatcgtccggtgctgccttaagtatgtatggttgatgctcaaagtcatcatccgtttctgaataaacaaaaggaatgcctcttgctgcatattcacggttttttaaggtcttgattttgtcaataccgctacgatggcgagccagactgcctattcccatgtccgactgctcgaacacggcatccagttctttgccgtataaggcactatgaaagatgatatatttctctaactgatgtttggctacatcttttttatagctgtccaccagttcgggaaccccgaagcctacgatattgagatatactttataatcatgagtgtcggtatgtgtacgatagtaatttgccatgccggctataactctgtcgaaaccatgccatgggtgcattgtcgctacggcaatcagttgtagagaatgtgcggtatcattctttggacctcttaaagggatttcgctgaaatcaattccatttgagatgcggatggtggggcgattccaaataatgtcatagtccgaaaaagtgacgatcttgtcaacatagcgtgccagatgctgtcggaaacatttgtctataaataggattcgttggtatacgaatgggagtcccttatattcttggtcgtatggatatgtcgggatttccatcactatacgtgctccggtcttttttagtagtttcatcagccgtatgctgaaagggctggcattatggacatagcgtacatagataaagtctatgttttctttctgtacataatgtacgatactgtcaaattcgattctttttaggatttttcctttgatcccgaaaccatagtcggcgattatcgattcatctaccatacggcgtttatggttgtccgtatcgtctagccaacacgtatgcatttctagtccgcattctttgagggcttttacttgataacgtatctttttactgattccgttgaatgcttcgaaaccatggaatatgaggaataatcctttcattgtttgttcttttgtactaactttctatttcttacaagagtcttcactttgcctgtgatatcataggtgtgtgttacttgcatatatgtcccaaagataataaaacttacgaaactttttgcaataagtgttacgaaaatattcatattttccatcatataatatataggcgtgaggaatgctgttattagtaggctgacaaggagtggagaaagaagttgtctgataaatatccatgcgtttctttggaatgtaactcgatacatcatccaatagcattgtacgaaattgatagtaaaagttatcacgatacatatggctacagctgtcagtgtaccgaaataaaatatccctgtcagcattccggtcacattaagtatggacgaaaagagtccgcagacaaaaaggctccttgtatcacctgctgcctgaaaaatagagcctgaagaggagagtatgatctgaataccgactgaaagtgaaagtatccggaatactggaaccgaaggcagccattgatcaccaaaaataatcagtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgaccggtgtgatgacttgcgtaatattctgcagagggagcatcatcaagcggtaggacttttcatagtatcctaaatcagacatactcatatatttaccaatcagcagtttatccagattgcggctgaaatagttaatcacgttaaacaagaattgataggccgaataggagaatatctttcggagtactttcagtcctaacgtgaaacgcagccgttgcggatagcgttgataggaaataacgaatatcagtatgctggaaagtataggattgatgatcagcgcatataagccggctccgcaaagcgcggcagttattgctccggcacctccggctatctggatgataaagcttcggacagcaataaacttgaactctttgttgcggtagaacaaggctcccggcacgatgttggcagaggcgaagaacaggttgacggacaggagctggcacaacgtccgtaagatcccactttcgtagtaatcggcgatcagccaggaagcggcaaaaaagagtatactgattccgatgcctgtccatacggtgaatgagaagatgtccgatagttcttctttagtcaatgatttatgttgtacgatagcaggcgatattcccatatccgtaaagagattgaaaaatgcaataatgaccgtagcgattgccactactccgaagtcatccggagagagcaaccgcgcaagaatccctgccacgacgagtgatataatgattccgctgtatttggctagtgccgtgtagaaaactccggaaaataactgatgtttaatattgtttgccattgcctgaatgattcttttctgatctacttgtgaatgatggatttgaataacaagactccgatgcttcttatagatataagttttttgtatctaaacagacaccgccacgccagccgaagccgatatgggtaaggaagcacatgggcttgccaaatgacagcattcagcatttgcgacagatataaatcaatagtatctttgattttgttttcagaggtttgttgcttgaatttgactatctcttgagtaacagtgagatatccttttaaatttttgagtgaaaaatcgcatgtcataattgaatttttacgtatgcgccggtgaaagaacgatcgttggatacagcttgttcttcgggcttgcagataaagtaaggtcgtgaatagctgatcttcgtgtacaatatccggataaaagaggagctgtcgttcttccaaaaaagctgtgcggataacgttcaggcaggcggatggggtgtacgttttgtgctgcaattgtatgttgattgcttcgggacctgtataaaccttgttttctaacttatcggtacgttgataatttagtacgggagcattgcgaatatcctcttcaaaaaagctctgagcatcaaagaaaacgaaatccagttctttttcttcgcatttgctgtagcacagttccattgcatccttttccaacagatcatcactatccatgaaatagatgtatcttccgtgggcatgcgtgatgccggcattgcgtgccattgacaatccctgattgctttgcgaatacacctgtatccgactgtctgccgcagccagttcttctacaacttgcagactgttatctgtggagccgtcattgatgatgatgatttccaattcccgcagtgtctgattcataatgctttctactgcctcccgaacatatttttcggtgttatagacaggtatgacgacactgacttttatttcttcattttccataaatactgtgtatggctactctattgttgtttgtttttgagatcgtttaaagagagagattggctaggtttctgtaaagctccgcatattcttttcctatttttccgctgttcatgttttcaatggcatacgcatagttgtcttctcccttccttcgggcggacagttggcgggctgcctccagtgctcgtatgatatcaaattggttgtcggggtggaagacggggttgcccgtatcttggaggatttctcctatattcccgatattgggacctatgaccactttgtgaaaaaggaaggcgagaggtatactggcagagttcagaatatcttttcgttggatgaatattacatccgaagcggccatgtagtaaggcaggtcgcagttgtctataggttcgtcgctggctccggcgtgcattctgcgcaggcggttgagcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctccggtcaccatccgcctctcttcacgattccggaactttccgaacgacgtgacgataaacgcctcctgcggcagattaagatactggcgcgcacgttccacgctgatgtcctccttgtatgtgtactgataaataggatgaggaatgatgacattccggctgtccgcgtgtttggctgcaaattcgtcgagactgtaacgtcccatgtgcaccaccacatcgctttgttcttcgataatgtcataagcacggccgatcacctcgttcgcatcatgcggacggacattgtggcgcgtatacacgaaccgggccccacgggaccggaaaaaagcgatacactccttcaggcggcaaatcctgtccggatcgtcacaattcccttccatcacctcttcgggccattggaagtggatgatgtcgtaaggtgtatccgagttccagaactcattcgtggaacatcgtacgtcaatccccgtcgtcctgatagcatcgcataaaatggggacaaaaagattgtccgtatctccattctctctgaaaacgattaatgcttttatcggtggattgcctatttcattgtcgttcatgcttgattctttgtttttggtgggcttttgccacatacaaaggtaataaaagatatgatacttttcatcttttttgctttttttcggtgttgtgcctttattccttgtgcgtccgttttatctctctgtcactctttagttgtgaaacgagttcatatctatgagaaacaggttcttgtcgaaggggatatgctgctcgtagaggtatttctgatagtggtagtatatcgttatgaggctctgtacgctgcatttggtcacttcgttttcgtaccggctcagggtagatatgctgagattggttacatctgccgcctcttcaaggttcagattacataggtgacgtatgtagatgattcgttcaacttgtgcatgacagttttcttcaatacgcagccggtcgttaatttcttctttagttgctctttcgtatcctttcataatttctatctttttacaaataatgccgcaaagttcatagaaaaatgtcaaacatcgtttgcagttctgcaagtagtttttcgaaaaagtatttagacctttgcagagcgaattcgggatgttctgaatcacagtcatttaattgtaagatatgaagaaagatcagtatttcaatttagaggtaaattttttgagtaatgacaatattgtcaggatgatgatggaacttgacgctgcgcaatcgctcggaatctatatgatgcttcttacgcatctgcgcaaagcggacaattatgaagcgtcctgttgtccgctttgtatgggggctttcgcacgaatgtatgatttggatgccggtgtgttgcaaagggttctccgtgagttcgacctttttgtgctcgacgaagaacggcaaatgttccggtcgccttatctggacagggtgatggcgaggctcgaagaaagacggatgattaatgtggcgaacggcaaaaaaggaggtcgtccgaaacgcatggagagcacgccggaaacaccgatggataaaggcgaaaaaccgaatcaaaaccagaagagtagagaagaggagagaagagttactactgttgtcaaagacaacaacagtagtaacgaagaaaagacagagaaagaaaattctgccgccgcttctgacagacttcagatcgtttctccaccggaggataggggacagttgcccctacagccggttcttccgtgggagatgctggtggatcagatggccgaatcggaaagttacatggagtcgatggctatgcactcctgtatgggcaaacttttcgtggagcggcaggaggaggtgatcgctgcttttaaagagcatatccgacgctttggcagggaagatggcttgctgtttttgagggatgtgaaattgtatttcggcaattacctctctccgggcggacgtccggctcaggagctgaagaaaaggctgctcggcagttgccggcaatcggctgaggaagaactgtatcgctttgaacaactcattggcgggcaacggacgtatcttgggcatccgattccgaaggatgcgcctccaagaccggacaggtctgccgtgtgggatgaagtgcattggaagtggggaaattagctccggatttctctgacatccggctacgtgagcgttgcctttcagctcaatgttcgttcattctcggctcggtgctcattcatgctcagctcggtgctcgttcatgctcgcctcgctgctcattcatgttcagctcgctgcttattggtgtttagcccggtgcccattgatgcttagctttctgtctgcattgggaactgatagaaaaattattaatacaaacttaaaatctccttttcggaagggaggaatagaaacaagaaatatgagaaattttgctaattatcatgtcgatgtccgcaggcataccagcggtgtcgttaaaaccatttgcgagcaatgcctcccgacgaggcacaacaagcgtgaccgttcgctgcgggtcaatatcgacacaggacattgccattgctaccattgcggagccgacttctacgtccccgacgatgccgaagagcgtgcgaaagccgagcgacaggctgcccgtaaacgtcgtgcggcatctgccgttccccagcatttccaccgtccggtgttcgacgcttcgaagacgacgctttccgaagctacggagcgttggctggtagagacgcgttgcattccgcagtccgtcatcgccggtctgcgcatcacggagcaggaagagttcatgtcgcaatccggcacgaaagagcggtgcgtctgtttcaactattttgaggacgggaaactcgtcaacaccaagttccgcagcggtgccaaaaatttcaaaatggtgcagggagccgaactgattccctacaatatcgattccgtgctgggacaggacacctgcatcatccacgaaggcgaactggatgccgcgtcctcccttgccaccggattcaaaagcgtgatctccgtacctgccggagctaacgcgaacctttcgtggctcgaccgcttcatggagtcgcacttcgagaatctgaaagacatcatcatagccgttgacaccgactctgccgggcttaaactgcgtgacgaactggtcaaccgtctgggtgccgaacgctgccgtgtggccgtctacggaccggggtgtaaggatgccaatgaacatcttgtcaaatatgggatcgacagccttcgcatcgccatcgagcaggcggaagaaatccctcttgaaggcatcttcaccgccgccgatctgcacgaagacctgcgggcattgttcgacaacggcttcggtcccggagcggagacgggctgggaggagatggataagatttgtacgtacgaacgtaggcggctggtcatcgttacgggcataccgggggccggaaaatcggaatggctggacgaactggtgttgcgcctctgtatgcgccatcagtggaagatagcgtttttcagtccggagaataatcctatcgtctaccatctccgcaagttgatcgagaaactgaccggacgccgttttcaaaacggttgcggcatgacggaaggacttctgctccgttcggaagagtttcttgccgaaaacgtctgtcacatcgccctcaaaggcagcgccactccggaacgggtgcttgccaaagcccgtgaacttgtcctgcgtcggggatgccgcatcttcgtcttcgacccggtcaaccgttttgagcataccccagcaccggggcaatcggaaacgcagtatctttccaattttctgaatctgtttacggagtttgccacgcaatataactgtctggtgattcttgtggcgcacccccgaaagatgaaccgcaatccggtgacaaaccatactccgcgtccggatatgtacgacgtaaacgggtctgccgatttcttcaacaaggcggattacggcttggtagtggagcgtgacaaggaggtcggagtgacacgtgtctatgtcgaaaaagtgaagttcaaacatctcggaacgggtggtgtggctacttttgtctacgatcccgtcagcggacgttacctcccctgcgaagagtcccaagacccgtccgtcccaccggaacaacgggtcagaaacactgtcaatgatagctcgtgctggttgccggagaaggagctgtttgaataggtaataggtaataagtattaggtattaagtattaagtattaggtaataagtaataggtaataatcgtagttggtgagggaatatgcattttagattgtcttgcaaaaaaacatttcagtcccgttttagttgtctggctctttgaatataaatcattaagataagtatcatataaagtatttattttatcaagttcttcatctgaaaatgattcgaatgggataggaaacatttctaattcggatgatcgtaagttatgccaatctgagtgtatcagccaaaaccaatagaaaaggttacttgacaaggctgctcctacaagactttgatatttttctctgactttcaattccccttctgcagaagaatgagtaggaatcttagttattattttatagtacctaccacctgccttccggtaataaataggtaaaccttctcgtttatacacatcttttattgttgtgacacaacgctctaatttgcataatattcctaattctatttcattgcctatctttggaattctcccattgcgaatatgatgaagggcatttacaaactttaggtcatctaagagtaaccacagagattcatcagaatagcgtttgttgatatgcgtagtcataattcttgtggccttgttgctggattttttaaaactaataatggatacttgttgttctgcactttcaaatatacggcgtggtctgtctccatatgaactgacatagatttcgtcacagtgatttattagtagtctatgaagtcctgacattgcatcggaagcagtaacacttagtggaacaataaagattgcatttcctttagtgtgtaatatttggtaacctaaatcaatgaaaagcgaaaaagtatctaaagatcctttttgtatattaggtatagtttgagcagatgtaaatatatgtttgaagcatgctttgtctatagatgaaattttagcaccatacggtggattgccaatgacaatatcgaagccctcttttgagggtcaacaatatgtcattgatacaatgcttccacaagattattgagctgttcttccaattcagagtaatcggtatttgtttctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagaagaatctgttttgcaatttcgccaatagcgttttgtatttctctttgcggaacaggtattggaagattacgaatatgttctggatatatgtgatagtcaccgcctcgttggtctgtcaacagctggtctgccatagaagaattaaggatgccaagcaaataatacaggtcgaccttctcagacagagattccatagcttcacggttatgtttactgaatttctttacactagaagatatgcttttattgctaacatctttcaaatctttccaaagaatagcacagtagatagagtgattatgcagaaagtgttcttctgcatctattgtcacgttgatagttcctaaacaattcatgataagttttggacggtcatacaactcgcgaaaagttggacggcgtagtttctctgggcagcgttccgtgttccattcaagatagcgtacacgtttgacttgaaatttgtctatatcctttgcttcaatatactttctacaatggatagcatcgtatgtgtcacttatcaaatcttcttttttgaatgctccttgggcatccttctcattggcattaacaaccattcctacgcttatatagcagaagtcacccaatacattcatattagcaaaacggtttcctgttctttcctcttctgtcaagttccaaacataattcttcttgtccagttttaatgcctttggagatttgcttaacacttcacggatggtcttgtcctcaaagatttgtgtgatgcgaagttcaccctctggttgactgttctgaataaatggaatacagttactcactgtggcattctcaaaaatctttgttccatttaggtcggctatttccaacaaacgatactcttctacaatcatcttacggagtttctttccatacttttgatttgtcaaaggatatgggactatcatagaaaatactccattggggcatagtaactgcataccaagttccatgaaaggaacatacaaatcccacttctcattaagcgatttatacttcttgcttgccactatacgctgccgctgttcgttcaattctggtgatgctatctgtgttggcgcactgatgtatggtgggttaccaatggctatgtcgaatccgcccccatttgagggtcgtgagaaaacatcatggaaccaggtatgccagaggaagaactgactgtttgcagacaagtccatatcttcaaaatcaatatgaataccttgttcaacgagttcctgctttacaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaatgtcctttctcagctgcattttcttgtcatgttcagggcaagcgtaatattcagtaagtttgtcgcgtagatttttgcgataaacatctaacatgctatcaaagaaagttagactttcaccagctcctattttcttttctgtcatcgttgaaaggtcaacacccttatattgctccagaagggaatttccctgcataatcttgaaatcaaggttaggcagagcctctggtgacttttcgtcaacaatcagtgagagccagaaacgaagtcgggctatatccactgctccacgttcaatgtcaacaccataaatgttgttttggataatgtgacgtttaatgttagctgcattctctacaatgtttggctcaatagcagaacggcagaagaacagttcgcgcagcaatcccattggaaaagcaccagagccaattgcagggtcgcatatcttcacatcgtacagtttctgatcaatgtattcctttaattcgcccagctgggatgcatcgtgagttgtcacaaactgacgtatacactccttgtcttcttccctcatgtctgtttgcagatatgctatcaagctttctcggcacatgtactgcacaatctctttcggcgtatagaatgcacccttatccttgttgtcctccagcaggttttcaaagatgcgtccaagcatttctgggtcaacgcccacttctgcatcgtttgggtcattttcatcgatggtaaagttgtactgcgagagcattgtcagcaggccattaaaatagctggcaggaaaatgactgggcttcttgtcaagaatgtcacgttcaaacagaccgccgttcaaatatggaatacgacagttgcggaagccttctacttttgtgtcgtaaaggtcgccctgatctgaacggttacggtctaaaccttctgtaaacaagtcttctaatatgtcatcaagaaagttttccttttgacgttcatttgcattcttgaaaatattcagcatgaaatcacgatcgccttcgccccattccttgcttgcaggaacgccaagccagcctttcttttggaggaagtgcaggaacacaatgcgtccaagaagtttcttcacatagtcacgaatgggtttttcctcacggtcacgaattttgtcagcagccatacccgtatggtcaaagcctgtatcaatgaagtgttgacgcattccgtttgtagggtcaaccatgtaattgacaaaagcttcgtattgagccttgtacttcccaaagaactctttagaaagagcttcaacgttgaatgcattttcgatgtctttaatttcaagagaattccttttgtcgtatagagctatgaagttgtcagttgccgtgcggcatgactgaccaggccccagcaggaacgtatagcgtttgctgtcggtggattcttctttgttgccactctttcggcaataggtgaaacgccaatcccaacgagtatcatcctcgtaatggaacagcatgaaggcacaagagaattgatccatgacagcacggatgagccgctggatgttcacacggttatgctccatcataacccggtcgctgactgtcacatcgaaaatctgtaaaggttcaacgccaacatacatcattccaacttgcttgatgctgcgtattcccgtcgcttctgccagttgtcttcgttcgggctgactctccaaaagctctgtttcaaaaccatcctcaaagtcatcttcaccgaaaatgggaaaaataacattgttgaggaacgaactccagccttgatatcggctgcttaaatattcttttaatgactccttattcatgggggtatttgtttacttgatggttcctaatacaatagatgcttcgccttgtttactttccacatgggctacgagtttgccgatttctcgctccagaatctcgtctatatcttgttgctctatggcaaagagacgtaaaccccgctcttctaattcctgaccaatagccaatacttttttgataatatcaaaacttcctcggtcaataaacttacgagcatttttcagcaaaatcttggattgtagtgataaactaggtgtgttgttaattttcaccaacatttcttttgcagccgtagccttgtcaccagcccttgacttgttgatgcggacaaagtattggttataagtctttatggcttctgccgaaagctgtcgccagttatctggtaatggaacacgtttggcattttctttcacacgcatatcttcaagcagttcaagcaaagaaattattttggcgttatacagaccctcggcttctgtacgtattctaattgcaagccttgcagagtgtggtgcttttactatgaaatatgccgttccacttgcagcctgtgctatctgccagtctttatcagcttgttctatttgcagataacgttcagggtgagtatccttgtattgtttcagttcatatacatacttctgcaaaggtgattcctcaccgtcaacagctttggcaatatcgtaatgtaccacactttcttcttccgagaaaatcttactgtcttcaccaaacaggacatggaaggattgtaacttggtatgtgccttgcgaaccaactgaatctgcgcatcgccttctgcacttggcatgaagttataaacatagacaaaaggctctttactgccgatacggtttacacgacctatgcgctgcatcaggcgagtggagttccaaggagtatcatagttcagaataacattggcacggtggaggttcacaccttctgccaagacctctgttgtaatgataacattgtagtcatccttccaaacaccttcgtaattggcatcgaaattttcctcaatcgtgtgttccatctcatcacgattggcagcagtaatgacaagtgccttatacccctttgcctttaccgctctcgcaagcgattgtactgtgtctatagcttccgagaagataaccaattttccagaggtattcttttgtggattaaacaattctggcttgatattctctttgaatgcatcaaatttcgggtcttgtgggtttttcgcccatcgatcatagagattagaaatgagtcggaagtcttctttcagttggatatagtattcctccttgaagtctttgcggttatattctgcattctgtcccttctcgttacgcccttgttccgtcaattttgttatcttggctctgatttcttctacacaatcattaaacgaaacacgtctaccacgtttcaatgttttggtttcatagtcaagttctttgtttacgtcaatttgcggacaaacgaaaattgtgtcgttctcccacatcttaatcatgttctctgtgtaacgtcgcaggttcaacagggattgggtgaaagcagtgaacgaactttcaagacgcttcacaagaagaatctgcatgatgattgcaagctgcttggcaacgtcgttgacaccacgattgcctcgaccagtatgttttctttcgttggcagggtcagtaaaatattcaatggcacgatagcggaaatattttaaccactcgtcagtctgcaacttttctgcctccgttggagcaatgattgtcatagtatcagagaacagttgagccaactcgtcatccatgatgtattcaagattgttaggtccaacaattttgggaaatatcaagccttgtgattccatatcatccttgtaatatttctcaacgtcagttcttgttcggcgttctagaatatcacttaacacgcaatcacgtagtctctttgacacggcatccaagcgttggcggcgctcatctgctggtatgtcgttgcttctatctatcagcgattcatattctcggttgacatctgcaaagaacctttcgatattaccactttcagccttcttcaatgtactgtcattgtggtttctctcaaaaaggtaaatctgattcttcaagtcatttggtcggttgttctgcggtgtggcagaaagaagacccacgtatggatatacccctgtattagaacaaatcttctgtatcagttcatcaagagactggtacatcaatgtggcactgttgcggaacttatggctttcgtcaatgacaataaagccataattcttttcttggagtgttccaccaaaatcgccagaatcgcggctgtcgtcatcgtcatcttcgcagctctcatcttcggcaacatttccgatgcgtccagttgtaatgaagtcaatgtatggcgcaatcttctcgtcagaatttttgtcgaacatggctatagtcttcttccaacccgattgaatggcaggaggagtaatgaccaatactttacgttctcgtccatcgtcttctggtacggacaagaaacgcttgatgatgagcgtaccaataatcgtcttgccaagtcccaccacatctgccaacataaagccaccatgttcgtgcataatgccgatacacctcttaacagcttctatttgatattccagtttgtggatgttcgctggcagataagtttctatctgttgtccgagtgatttgtctacaatgtcaccaaacttaatttgtagcaatttgatatatagttcgtatggagtgaatgattgttgttcacttttgcgttctttttccacgtcatctgttataggtgcagatttaaggatttgttctaagaattgtttgttccaaggttcagatatttcccatttttcattaaaccatatcaaatgagatttattaccaggtatttcatcaagcgataacacttgatttggagctgtttcaatatagtttaattcagcgttaccttgtaatcctttttgtgtaaaatttgtactacccacgataccaataccaatgccgtttgactttccgtcaaagatgtaacacttagaatgtaaaaattgagtttcgtcattttcattttttcgaaatacacgaatctgaatctttgaatcattgttttccgtacaataatcaagaagcagacgtatagcatctttatattcctcagtaacattaagttcgtggatatcagtttttatgaagtccagcggataatttgcatctttatatttaggtgactttaattgatttacgtatatataagggtcttttcctataagtaaacgaagcgttgttccttctttttcaatgaaagacctcaaattttcttgtagtatagctaaaccgggaatatcccaatagcctgtggcaatactaactgttttaataccatcaatggctaagcattttctcaatgttgttgtcattgaaagtgcttctatggaattatctataagtgtattattcattttaattctattctatggtttgaaaatatgcgctaattacattctttctctctcctctcttttactttttccaatcccggcatctttttagccaatgcactttctcctgctggaaaatagagaggaaaaactttatataagaaacccacaacttcactacgacttttatccatattgtaaaaagcagagcagacaaagtacattagttcttgctgactacatgtttctttaggttgtatgcttattgagggagcaactatcaagtcatgttcagcaaatgatagagcactggcaagaatagcttcctgttcttcttcggtaaacatctttattttcccagctaaccattcaagctctctttgccggagtgcttgttgtttttcgttttgatgctccaataggattgctacattttcttgttgcttttctgtcaaggcgttttctaatgcttggttctttcgtttaagaacgttgaattttagcaaagcagcaatgtacatacagaaatatcctactgcaatatcgaatattaggacaagcagataattgttacttgagttttgtatgccaccagccatatattcactaatagggataacagctaatagcatgataatggctattgcataaagcactcggtatcgcgttttatggtttacctgtggcaaagaggcaaacaaaaaggcgataatcaaaacggctatgattgcaaagagtggtatgaaagaggtctccataggtttgttgttctgtttatggtttaacaataatgcgccaataaccagccttgtctgaaccttcgtgaaccaaaattcccatacccctaaggctcttgatatttttctctatagcgcgtttagttacaccaatcttgttggccatattatcagctgtgattgaaggatctgaaataacgaggtcgattatcttttgtgcagttttactgactttcttctgtgtttccgatgtatctccgaacttatccgcatttacaccgaacttttcgaccgaactttcttcatttacaccgaactcttttgtgtttacaccgaacttttcgaccgaactttcttcgtttacagggtacttttcgagggtactatttaccctgttggctacttcctctacaggtattcttccgctttcgttccagttcaaattatagaacgtggtgtagaaagaggtcgcttccgtttgatattgcggttctttgccttgcaagaaattaggtaatttctctgtaagctctcgcattttgcgtaaaccggaaccacgtttctccatataatccaactgtgtgaacacatctgcaatgacaggattacgacgcatggacggcactttgtatatgtcacggtcttgaatttgtgtaccgtcaagcatagcaccaggtgataccagttctacgcggtcatcataaatgtcgatatgtacttcaccgcccattatagtataatctctatggataaggtggtttaccagtccttcaaagatggcacggtcggaatagtcggggaggttaaggcgatagtttggcatcttcacccagccgctcatggtatagtttttgatgaaatccataccatattttaagagcagcacaaggttagcccgatgttctacggaactgatggcatcatccttatagagtccagtccaacgggtgcagaaaatacgcgattgaaataccgtgcaattatccacaaacagcaatcctgcattggtcagtttgccgtcaggagttactagtccgaatgattccagatacttgtcgttccattcttgatgggtttgctcacggaaagtattggcaaggatgatgaaagaatgtttgccggcatccacttgggtaggaagagaatcccatgtcatgtgcgtgccttttaataccaacgaaagtaattgttgggagttgcattctacactttcattgccaactcgtacatatgcggtacgtgtcccatcctgataatagtaataaggtgtaagcgttcctgcctttactttcacttcaagcagggtatgcccttcgtgttctatcggaataagctgaacttccggcacagggtcaagtcgtgccttcatcatttcactgataaaatcagcatcggcttgtggattctccaaccctacaattacaccttcatcattcactccataaaacaaactgccaccgtccgtattggcaaaagccgacacggatttaagccatgactttactttcttacgttccagcatttccttgaaatcgtaagccgagcattccactatcaatgtattgttatgtatttgcatagtttccttattgttgttcgggtataatatcccaatatcatacacaaaggtaaggataaaaccgaagaatctgttaaaaacatcgctttcttttgatttttatgcgtttatgtctcgttgtttatgaataaaaatcgtacttttgtgagcaagagcgtgtgttgcttatggatgcttattttcgggtttgtgttatatttgcaacacgtgtacgcaagttgctgataggtatatcatgttgattttgaggaagtgaagtaagattagctgaattagtatatataaaaaggtgtgtcagaactttttctgacacacctttttgaattttataattagcctattgaaaataaatagaaaggtttttgtttattttggtgaagccatatattttgttgtttcaataaatgtcactttttcccttttgctctttcctgcaccaatatatctttcatttcttttactatggctggatatttcggagccagattttcgctttcaaactcggacttattcatatcgaacagctgatcataaggtgcatatcctgtttctattttcggaccccaagtgatcatgggggaaccattggaaggttcgatatatttccattttcctttgcgtacggataatgccagaatattagattcctcgataacccaaggacgatcttttttactttttcctaaccaactgtctaaatgattttgactgtccggagctttactttggggaatagtgacatttactagagaagccaatgattggatccagtctatttggcttagcaatgtgtttaaagtttggttctttttcacctgtgccggatagcgtacgatggccggaacacatgttcccgcttcgaaggcactgtattttccaccacggaaaggaccacccggcttatgactgccagcaagctcaacggctttgtcatcataaccatcatccagtaccggaccgttatcgctggatagaataatgagtgtgttttcagtcaatcccagccggtctaacgttttcatgatttctcccacgctccagtcaaactgtacaatggcatcacctcgtaatcccatcgggtttttacctctgaaacgttcgtgtgggaagcggggaacatgtacatcattggtcgcaaaataaagaaagaaaggccgctctttgttttcttcaatgaaacggatggcatgactggtgatggtgtctgctatattttcatctttccacaaagctttacctcctcctttcatgtatccgatgcgcgagataccgtttacgattgccatgtcgtgtccgtggcttggcttgagattataaagcaattcaggattctttcttcctgtcggctcaccttcaaatggtttctgataactgacttcaataggagcggtggaatcatagtcggctactttaccgttttcaatataaatgcaaggaacacggtctgcagtagcagccatgatataagaatagtcgaatcctatatctttgagtgcaggagatattgtcccgttccagtcttgtgtacccgttttgtcacctaatcctagatgccatttaccaatagctccggtggtatagtctgccgatttaaacatatcggctatagtatattgttctggtcgaattatcatgcctgcattacctgcagctactccggtacctttctttctccatgcatattctccggtcagcaaagcatagcgggaaggagtactggtagaagcggtagcatgtacattggtaaaccgtataccttcagaagccaaccgatttacattgggggtatgtacacgtgtggtaccataacattcaagatcaccataacctaaatcgtctgcgagaatgataataacattaggttttgtttttttttctttttttgaactttgcccggcatacgcgggcaaagaacaagaacatagaactgcgacacaaggcagcagattgagggatcttttattcatcatgtgtttaaatcaaataaggttttgagtataatactgatttttaattattaccttctaatccgtaaacagtcaattcgcgaatggcggcaggaggacagttatttccatatccttcaggaattataagtttcagatatcgtgctttggtagactttacataatatcggaatgttgctctggtaccttcatcattaaaatcaccggcaccaattttatcccattcactattgttattgctggcataaaattctacccatttaatattattggcagctccgtctccacgattaagtaagtcaatttgagcgattgtaatttcttttttcatatcaataataaaatggaagggaggtacagatgatcctgcttcatttttgaatttgcaatgccagtatgtactttcattatcgtcaatcatgtatgtagcttcattccctgcatgttcagaactgcactctatcacttcccatccggatttgttgatcttattcccttcttttacaatacagaacaaaacgttgctttcctcatctattaccagtgagttattcggaactcctccttggcttgccgtgatacttcctatttttataggtaaaatatagtttcccggtaccagattgttttttagttggtaggaggcggttatctgactgactccttcctgaagagttacggattcaggagcagtataggcattttcgggaagtaaagtgaaatttactttattaatctgattatattcgtcaatcaatgataaatcttctgtcagattacaaagaatatcccacttattggtaaagggtactccgatctgtatatccattgtagaagttagatccggattgatattatatactccagcattactgatatgaacgataggttccaaaatggtaaatgcaagaaaagatgtatttcttgctggattaatagccagatcgttagaaatgagtcgtaatggcaatacatattttgtttcgttatacgctgacaaagccagtatcttttcaggatggtacgtgatgtaaccgcataactcgtttttatctaccgtaaattctgtatttgtcatttcataacaattttccggcaataactcataattagttttatcttcttgattcagcgagtcaagcaaaagagggtctacaacgaattgaactttaccggaggcatctttcagtcctccccgttgtatccatagttccgcttgggcagtttctccgacattataggctgcttgattattcaaggtgttgactgtaacagatatcagactgtctgctttatcggagacatcaaattcattctcgcaacttattgccagcatcgcaatagtcattgctgctaataaggtatgtatcgttttcatattgttattatatttttaatcatgaaatataattaagattaccatcccggattctgaacaagttgtccatcagactttttcatttcactatccggaataggatataggtacattttgcgtctgaatacgatggggctggcctctacttcctgaaggaatttatcttcagttccattcatgttcataccatgcacgtatccatattgacgtccttcaccttcttggtcagctatcatccagcggcgtacgtcgaaataacgttgtccttcagtagccagttcgatgcggcgttcacgctgtatagccagtctttgcagatcctgtttgcctgcaatgtcaggattcaaaatttctatattttctaatcctgcgcggtgacgtactttattcaggtaggtcaatactcgtgcatcgttaggatcgatttcgttgacagcttctgcgtatagcaggtaaaaatcggctagacggaaaatgatagaaggacggaattttgatgtaactcccggtgatttcttattaacctcacgattaaatctcttatacagcatatagcccgtaagagtataaatagtaccactaagttcattaggacttcctttatggaactgggtaacgttattactgacgtgccatcttctgttttgaaagaatacggtattatagaaacgtggttcacgattcatgaatcgattgctgacattcttggcatcacttactttcttattgttgctggtaacgactttttccttataagtgtctgttccctcggttgtgtagagtgtagactgttttaggaaacttgtttcttgtaccggataaccatcattcatatagaatgcatctaccaattcttgagtgacacccgtacatcccattccattttgttcacttcttggggtacatctgcggtcaaaggcatctccatccataccaccccaggtattggcagcagtggcccatataatttctcgattgtaagtttgaaataaatcatacaatgcttgtgaagggttctcttcattttccaacaattcataattgttttcatcttcagcgaatgtcatgaaatctttcaaagcacttactgctttctcccattttccgggatctttatctgggaaaagccgttgtccgtcaggattagtaatcgataatgcttctttgtactcgccattgaataatttactggcggcatatacccatagtttagctctgactgccagtgctacaccttttgtgggccacgcattgtgttggtcatcctcatgtagagcttcttgtgacagttcattggatacttctttcagttcctgatcaatgtaagctataatctcatcaatcggactacgtggaatatctaagtcatcatctctttcgtaaatggcgtcttttacaagaggaataggtccatattgctcaaacaaaagataatgataataagctctcataaaacggacattagctttcatttctataagttcctcttctgtcagaacatcgacgtgggtgccattggcagctattggtttggcattggccagaaaaatattagcttgccgaatttgtttataacaatttccccaacggtgaaaacccatgtttgctgcatttttttctgttttattgtataatttgttgtctccatagccaacggttagttcgtcacacataccagcccaagggtttttgaagcctgtgacgttgccttctgcagcgacgatacccgaataatcagggatagcagtaaaaatattggcataccatcttttggtataggcgacattgtcaaatatctcatccaacgattgaagatttccggctagttcatctgatacatccagatagttgcatgaacagagattgcatagcgtaaaagctactatcagtactttcctatatagtttcttttttgttttcatacttaataaatttaattagaatgtaaagtcaattcctaaagtaaatgtccgtgctttggggtatgtattaccaccattggcattaccagcttccggatcaaaatatttcagatcgtcccataaagcaatgttatatcccatcagatagattctggctgcctgaagatttattttacttaagagttttttgggtaattggtaacctaattccacgttcttgagacgtaagaatcctccgttgcgtaaccaccaagtgcttgctacactattattagcggcattggtgttgtctttatgtaagcgtggcattaatacgttttggcttggatttttttcagtccacctgtctaaagcgaatgtacggtaattcgattggtctactccccatgagaaaggaaaccatccttcaggggtattacctcccagcaaaacggaacagttgccggcaccttgaaagaatgcgctggcataaaatcctttatattctatatttagcccaaatccatatacaatttctggaactttgggatgtcctacacctcttactttatcatagctatcgataatgccgtctccatttatatctttatatttgatatcaccaggacctaacagtccccccaatgtgctttggggtaattcagaacgtagagtataagtttcgatgccactaccgtttttgctgacaataaagtcttcttttgtatataaacgttctgctatatataaataattttcgtttattctcatacctgtctgagccatccaaggatatctttgtggtaattcatcatattcaacgatcttatttcttgcataggtaaaggttccacgtgcactgagttttacttttcctatttgctgatgaatattcagtgacatatctacgccatgattattaacaataccgtagttggcatattgattgacgcggaatccgcctacagtaggagtagtatttctttgcatcagaatatgacttctttcagagcggaaataatcgaatacaaaatcaactttgttgtcaaacagtcctaggtcgaagccgtaattttgtttagtttcaatttcccaaccgatatccagcgtttcggggaatccttcgatgatagcattgcctattgcattggtacctccgttacttcctataccttgtgaccatgaaccggctgccatattataagtagctctataaacaaaacgtttatcggtagtatcattaccggtttttccgacagaagctctgattttaatcttattggctattttctttattgctttgggatagaatggctcattggatagatagtaagcaactcctacagctgggaagaaaccgaaccggtgattcttggcgaaggcttccgaaccggtatatccgaagttaccttcaataaagtaacgtccgtcataagcataacttacacgtcctactacaccttgtttacggtatggtagtggctcggttttatattgtgtttctttttgcatatagagcaacattccggttacatcatgtttttcagcaaaggtccgtttatagttgatggaagcatcaatatatatttttttgttcgcttcgataccgttgtccttcaggtcgctaaggtctggagtaccggaaactacttgtgcgaattgaagattcccgttttcgtctctgcctgttgcatgataacgtgatggattgtatgaacgtatggatttgaaagttgcgtcgaagtcataactgatattcattttagcacttaatcctttggttatgaatttcagattttgttgtacgcctactttcgactggattcctgtccgccattggcgggtatatccggagttcattaacagattgtatggattcctcatattaactcctcgttcctgttcataagtggctactgtgccatcactgtatacagcaggaaaacagtatggaggggtaattaacatggaacggaagatactggatgaagatgagcctggatagttagctatcaagtattgtcctgccaaatcaacagaaattttagttgttgaggtgacatccatatcaatgtttgaacgaagattaaaacggtcaagtccgatatttgtatcatacttgtctgtagggttgcctttgtaaattccactttcattataatatgcacctgaaacaaagtactttgcacgtgcggaaccgccacggacatttagtgtgtatcgatgattatttgtagttttcttgagcaactctttaatccagtctgtattaggatagaggtcaggatcagtgctgttacgaaacttttctatggtttcgtcactgaataaagcaggttcaccgtcgttacgcaatgcttcattatataatcctagataatcggcagatcccacaaattctggcaaacgttggggacttgaaatagaatgctcggtcttaaaagtaattttcggcttttcatctttaccgcgtttggtagtgactaatataactccatttgcaccttctgcaccatagatagctgttgcagcagcatcctttaggatggaaaaagtttcaatttcatccggttcgatatctgtaattttacggggaataccgtccactaaaactaggggagtagaagctgccgagttgcttgcaaatgtactgataccacgaatccaaaattcggcatcatcaaatcccggttcactggatcgttgtattgctataagaccggaaacttgtccggccagattattagtcagatttcttgttggagctgttatgtctgaaactttgacggaactcatggatacaactacactttcctttttttgctgtccatatcccactactacaacttcatccagtgcttttgtgtcttcgcgcaatcttatattgatgtttcgacgatcattgattttaacttcttcagttgaatagccaatatatgaaattaccaaaatactgttttttccgggtgcagtaattgtatagcgtccgtccatatcggtgattactccattggttgtatctttgattctcacagatgctccgattactgactctccttgtgaatcagtgacaacaccggtgattacaaatttatttttttcttgttgaggagttggctgctctcctttgcggtaaatggtaatttgccgatcgttgatactgtaagtgttatcggttccggcaaaaagttgatctaggatagcacttacttgttgctttctgacattgatattcactttgcggttcgtatcaatgagttggtccatgtagaaaataatatattcactatttttctcaatttcatgaaagacttccgttatagtcttttgtgatgatttaatggtgaatagtttattctgcgaatacgtgtttgtagccaaacagtttcctattccgataagaaggaagagtgaaaaaaacttcatgattagtaatagttgtttatctttagtcctttggtgactaaataatcggtgctttttcatacatttgtaatgattagattaattaatattaacgtgtaagtaatttaatcaaaggccggatgatattaaggcattttcaccttatattatatatacaataaaaaaggcatatcgcctgatgaatatccgatatgcctgaacgactgatctctagttattatttccgctttcggacaggtaatactatcctgagtacaatgtatcctaataatccggaaagaatagtccccgatagcactccgaacttagcctgattcaacagaacagggtagtttgcaccaaaagaaagattggcaatgaaaagcgacaccgtaaaaccgatccctcccaacagagctataccggaaagattcttccaagtcatgcccggcggcattggagtaagttttatctttatagccaaccaggtaaagaaataaattcccgcaaatttaccaaacagcaaccctgctgccactgccatccctacacttcccaccaactcaccgccgccactaaagacaacgcctgcattgacaaaggcaaacaacggaagaatcagataattgacagctccatgcaaattatcctccaaagactgcagaggactgataacacggtcggaagcagattcgacctctttcagtttggcaatctgctcattagtcaatacgatacttcccgattccaccaccgggaaacctgcaattgtatgacgaatatgctcgatatattttccaacatctagacggggtttcgccggaataacaaacgccagaataactcccgaaatggtactatgaataccggattgcaaaaataaataccatataacgacaccgatcactaaaaagaaaatcttattggtagtcccacgcttccctataaaataaagtaaaacgtaaagcaatgcggctatcaaaatatacccatacgacacatgcgaactataaaaaagagcaattacaaggatacctccgatatcatcaactaccgcaaaagccgtcagaaatatcttcaggctcaacggcacacggcttcccaacagacttaatacccctaacgaaaaagcaatatccgttgccattggaatggccaatccctgacttcccgcactgcccggaggacagattgacatgtaaacaatcaccggaaacagcataccgccacaggcagcaataaagggaagcgccgccttgcggaaggaagaaagctcaccaaccaacaactcccgtttgatttccaatcctaccagcaagaaaaagatggtcatcaacccgtcattgatgaactcgatcatccgcagattctctccgccatgcgaaagcagattaaaattaccgatctgcaaatgaagttcatgcaaaaggaactcctgataaaccggagcaaccggagaattggctatgatagcagccgctattgccgctacaaacaaaaggatactcgccgcaatattcattgacgagaaatttcgcattgtacgcaaaattgtcataatgaaaggtgtttatagtatttgatccgcaatatatggatttttttaatcattatagctccttaaagccaagtttttcacccaaaggacaaatattcctgtcagaataagattcaacaccaatgtaagtacggaaatgaccagtgccggaccgccgagattataacccaatgcaataaatataattccggcacctacctcaccgcgggtaaacataccaatggaaagggccagtcgctcactcaacttccggtcacgatagaagaacatcggacaaagtttgcctatattcgataagaaagagactatgacaacatggaacaaaatcattccccaggacatcatctcctgcgaacctgtcaccgaatgcgttcctgtatgagtttccgcaaagttaactccgataaaatgaggcatactcatacctaccaggaacataaacaggaaggagattccagtagagacttttcgttctacaggagtatcgtgctctttatgcttcatgatcatacccaatacaaatgccggcaacagaacttcgatatggatacttccttcttctccatacagctctttactgccgagataaagtatctgcgtagccagaaatatgataacggaatagaagagaatagctttccaatcctgccgccagttatacttattcagttgtttccatccaatggacaacagcataaatacaataaccaccacaataatcagctgccaacgcaaaccaatcatcatgatctgaagagggatcatcaaaagaatggtatccagatcatcaaaaatagccaggacctgaatcttcttatatatccagctggactttaacccgatagccgccagcatcgtaaacaagatgccggccgacgtaggtgcggcaaaacgacttagtaacagattctctttccaagcctcccaactattccagtaatcaggcggaagaagcacgaatacataatagatagcaatcatgaaccaaggcagggcagctgtagccatcgctataagataatcctcggcataacttttccagcggactttgtcgagcacaaactcccgacccacattaatcattataaaactaagacatacataaagtagtatattcgacaggaccttaacagttccatatccttctcccgctatcatcgggaggaattgtgaaatgacgagccccaacatcaggaagcccgaaaaagacagaacttttctcatatttatagttgtttgtttcaaaaaaggtgattgccaaggaaagctctgcagacagaagacaatcacctggtgtattaaaaaactaaccgcaagccgatttgttcagaataactctctgaaaaatcgcttgcggttcattttttaatccagcttcagtacggcgaggaaggctttctgcggcacttccacattaccgatttgtttcattcgttttttaccctttttctgcttttcaagcagtttacgtttacggcttacgtcaccaccataacacttcgcagttacatccttgcgaactgccttaatagtttcacgagctataatcttagccccgatagctgcctgaatagcgatttcaaactgctggcgagggattaattctttcagtttctcacacatccggcgtcccatatcatacgcgttatcgaagtgaatcagcgtagaaagcgcatcgaccggttcaccattcaacatgatgtccagtttcaccaacttggaaggacggaaaccattgggatgatagtcgaacgacgcatatcctttcgaaatactcttcaatcggtcatagaagtcgatcacgatttcacccaaaggcatgttataatatatttccacacgattaccggaaatatactcttgtttcaagagttctccacgtttccccagacagagggtcataatcgggccgatataatcggtagtcgtaataatagacgctttgatataaggttcttcaatatggtcgatcaacgtcggatcaggcataccaccggggttatgcacttctttcatattgccttgtttatcatatatattataagatacgttaggcacggtagtaatcacattcatgtcgaattcacgatccagacgttcctgtacaatctccatgtgaagcaatccgaggaaaccgcaacggaaaccgaagcccagtgccaatgaagattccggctggaaagtcagcgaagcgtcattcaactgcaatttttccaaagaagcacgcagatcctcaaaatcttccgcctcaatcggatagactccggcaaaaaccattggcttcacttcttcaaaacccgcaatcgctttatcacacggacgggcaacatgagtaatggtatctcccactttcacctctttcgaggtcttgatacccgatataatgtaacctacatcgcccgtacgaagttcgttacgtggaaccagttccattttcagtacacctacttcatcggcatcatactcttttccggtattaaagaacttcactttatctcccttgcggattactccattttcgatcttaaagtaagcgataataccacggaaggagttgaatacagagtcaaaaatcaatgcctgcaacggagcttcctcatcaccttcgggatgcggaatgcgttcgataacggctgcgaggatttcctccacgcccattccggtcttaccggatgcacggataatctcatcacgcttgcagcccaacagttctacgatttcgtcctctacctcttcgggcatggcacttgccatatcacatttattgataatggggataatttcgagatcatgttcgatagccatatacagattggagatggtctgtgcctgcactccctgcgatgcgtctacgataagcagcgcaccttcgcaagcggcaatggaacgggatacctcatacgaaaaatccacgtgccccggagtgtcaatcaggttaaggatatacttttcacctttgtagttgtactccatctggatagcgtggctcttgatggtgatacctctctccttctccaaatccatatcatcaagcatctgcccgttagtcacctgaatagtgttggtaaactccagcaagcggtctgccagggttgatttaccgtggtcaatgtgggcaatgatgcagaaatttcgtatattcttcattctgaattcttattattttgtctttttggtgtgcaaagatacgtaaatggcggaatataaaaaaatgcgttgataacattataatcatgtaccaacgcatttttttattgcttaagtgagttactcgcttagatcaatttgatgaagagttcaccttctacttcttcagcagaaactttatcttctctcaataaccagccaaggccgaggaacaaatctttgtcaaccaatttagttgcttttttcagttgcttggcagtcattccttctgtttcattcagtgcattccagatattacctgcgattacacctgctttttctttcaacatttgcttttgaaattatagttagacatgctttaaaaatcatccggcccgaaagctttcagattttatttcggggacaaagatagttatttttatgttatataacactttattgaatctttttttgctgattttgtaataaaaaagcattttatccccttatttagggtgtttttcgaggtattctacccagattcttgccgcctcttccaccattttagcacacggacgtttgctataatattgagtattacgttcttcgggaacagtcgaaatcggctcttttttctttaatcccaacaattctccgcaaatcaacgacccgttgcgttttttaaattcggcagccaattcctgcactaccgcatagtttgcagcttttccttcacgatctgtcgcttcggtagctccggtttccagtccggctatcaggaacagtccgcaagcagccccgcatgtctcacgcatccgcccgattcctccgccaaaagaggctgacatacgcactgcctgctcctgtgtgaaaccatacatatcggcaaatgcagctactacagactgcgagcagttatatccgctcttaaaaagttctacagctttttgtattctatcttccatgctattttctgtttttattctatttccaaagccattggacaatgatctgaatgtacggcatcgttcagtatgctggcacttttcagcatcggacgtaccggctcactggtcatgcaatagtcaatccgccagcctttattcttggcacgcgaattaaaacgatagctccaccacgtatactcctgtttctccggatagagcagacggaaagaatcaataaatcctgcagaaaggaaacgagtcatccattcccgttcttcgggcaggaagccgctgttcgtggcattccggacaggatcatgaatatcaatcggctcatgacagatattatagtcaccgcaaaggataaggttcggacgagtcttgcgcagctctgtcacatatttctgaaagtcttccagccacaccattttaaatgcctgccgttcgtctccgctcgttcccgaaggatgataaacactgactacggacaagtcgccaaaatccgcacggataaaacgcccttcattgtcataagcttctatccccataccatattccacatgatcgggttcctgcttagtaaggatcgccacaccgctgtatcccttcttttgtgcagaatagagataagccttgtaacccaaagcttcaaatacttctgccggatattggtccggctgtagttttgtctcttgcagacaaagaatatccggattctcctgcaccagccattccggcaaacctttagaagcggcagcacgaagcccgttcacattataagtaataatcttcatcattttatagtttatagatttatgttcgttttatgaaaacagcagcattatattcaataccgaaacaatgactgcaatagcatataatacaaaagtactccaacggctattgacataattccccattacctttcgggatgaagtcagccctacttgcaggaataccgtgaaaggcaactgaatactcaatatcatctgcgaaatcagtaatcccttgaatggatcgccaataaagaaaatcagcaacagcgcaattcccaacgaaaggattactcctacctgcgagtgactgtctttaatatgatatgactctccaaagatacctgcaaagatagaacctgccgccattccgcttgttatagtggacgaaatacctgccatcaacagagccaatgcgaatacgattgccgcattacttcccaacaaaggttcaagcagtgatttggcttgttgcaattcttccacctgaatgccgcttttaaagaaagtagcagcagccagcagaatcatagcactgttaattgcccagccaacgatcatcgagaaaagcgtatcgaacaactcgtatttcaatactttcttgatagacgcatcgtctttcttattatactcgtgactctgtattacttccgaatgcagaaacagattatgaggcatcacaaccgctcccagcacactcataataatcagcatactacccttcgggaaagcaggcgtcacccaacccatcgtcgcagccggccagtctatttctaccagaaacaattcataaataaatgaaagaccgatcaccgagacaaaagcaataatggaacgttctatctttttataggagttggtaaagagcatgatggagacaaaaagtgtggtcagcaccgccccccacataataggcatatcaaacagcatctccaatgcgatggctcctcccagaatctcagccaatgaagtagaaatagacgccaataccgccgtacccaaaataggacgggatacccatttaggagtatatttcgtagcggcttccgaaaggcaaagccccgtaacaatccccaagtgagcaacattatgctggaggacaatcaacatgatagtggataaggtgaccacccaaagaagtgaatagccgaactcggaacctgcggcaaaatttgatgcccagttgcccggatcaataaatccgacagttaccaaaagtccgggaccaatatatttaaaaacatccagtccgcccagataacgtttatgatctttccgtttcaagtcttgaaaaatattcttcatcattgcataatagtttattcagcacaaatatacttataaataacgaccgaaggtcgattttggttcaaaataccgacaaatagggaaaggtacggcacaataaaaaacctccggcaaaatgaattgccggaggccagtgtatattttataaagggagacttccgttaatatcccatttcatgcagtgcatggcacaactgatcgggacaggacgtcggtctgccactgcaacgtactccttcaagtttcttgataacctcttctaccttcattccctttaccagacgtgaaagtccctgaagatttccgttacatcctccccaaaaggcaacttccttcacaactccatcttctacattcagttcgatgtttgtgctgcaagtaccctgggttctataaacatattccataatccacttactcctcgtttccgccttcttccggcttcatgtttgtataaacagtctgcacgtcatcaaattcttcaagacgttctatcatcttatctaaagtttcgcgttgttccggggttacctctttcagatcgttcgggatataagtaaaatcaccgccgacatcctcgaagccacactcttcaagatgtttctgaatagcggcatagctcttaggatcaccgtagatagtgattgttccttcttcgtcatcctgttcgtactcatcttctacgtcgtaatcaatcagatcaaggatcagttcttccatatccatgccgtcctttatcttgaaagtgaacatacatttatggtcgaaaaggaaagccaatgatcccattgttccgaggttaccaccaaatttattgaatacagagcgtacatcggctaccgtacgagtcgtattatcagtcagcgtatctacaaagacagcaattccgtgaggaccgtatccttcgtaagtcatgctcttgtagtcgctctggtccttacccattgcattcttaatcgcacgttcgatattgtccttcggcatattctcacgcttacaagtagcgatgaccgaacgcagtgtcgggttattttccggttccggaccacccgccttcacggcaatagcgatctgtttacccagtcttgtaaatgttttagccatgtggccccatcttttcagctttgcggcttttctatattcaaatgctcttcccattggtttgtattaattttgaattgtgaattttaaatttatctcaattttgcattcagcttatcttccagattcttcaccagtttagacatgatcttatcgatcatcttatcgttcagcgtctgagtttcatcctgaagcaggaagctgaccgcatacgatttcttacctgcttcgatgttcttaccttcgtatacatcgaagagttccacttctttcagcagtttcttttctgtatcgtaagcgattttttcgatttcggcaaactgtacgttcttgtcgagcaacaatgccaagtcacgcttcacagcagggaatttggaaatttccttgtagctgatcttcactgaacggatagccttcatcagttctttccagttcaagtcggcataatacacctcattatctatatcgaatgctttcagcagtttcttcgtcacaacaccgaaagaggcaagacgcttcccccccttggtatgaacagaaagtgcggtagcgaaaatatcgtcagtcagattgccaactaccaggttgtgcaaatccagtcccaggcgcttcaatatattctctacataagccttcaattcgtataccgaactgttttcatccgggtgtgcccatgagttggctactttctttccagtcacccacaaacccaagtgatagtcttccgaataggtagccagtactttttccggattcttcttgtccgcatcgaagtaatagcagttaccgaattcgaagaatttcaaatcggcattcttgcggtttgcattgtgagcgatactttccagtccaccgaacagcaatgtctgacgcatacagttcagatcggcactcagtggattcagcagcatcaccagatggttggatgaatagttctccagaccgtcgtagtaagcggcacgagtcagagaattattcagtatttcattgaagccacagccaaccagctgttctgcaaccagattctgtaatttgtttgatttatcatgctcacccttggttgtcagactggagttcagcgtagtcgggatttctacattattatatccatagatacgtagaatatcttcgatcacatcgcaatcacgctgtacgtctacacgataaggaggaacggccaatgtcagtccgtcaactgtctcattcatgattttcatttccaggctggtaacaatgctcttgatcgtttccacgggaatcactttaccaatcagcgaatttactttctcataagaaagttctaccataaagtcttgtggaactgcaacgcaaacatccttaatttcggatgagatagtgccaccggccagttctttcaccatcagagcagccagtttcagacaatagattactccgttcggatcgatgccacgttcgaaacggaaagaagcatccgtattcagaccgtgacgacgggcagtcttacgcacccatgtaggatggaaataagcgctttcgataaatacatctgtcgtagcttccgtagaaccggaatccagtccgccgaatacaccggcaatacacatcgcttcttctttgttgcagatcatcagatcgcgttcgctcaacttgcgttccacttcatccaatgtgacgaatggagtgccttccggcaatgtcttgacaattacttcattgccttttatctttccggcatcgaaacaatgcaatggctgaccgaaagcatgaacgatataattagtaatatccactacattattaataggacgtacaccgatcaagcgcaatttattctgcaaccattcggggctttccttcacagtaacgcctttcaccgtaacgccggcatagtgaggacaggcttcgctgttttcaaccactacttcgatatccaaatcatgattttccaccttaaatccatctacagatggacgttgcaaagtagcctgcttgccattctgaatcaggtaagcatacaagtcgcgggccacaccatagtgtgagcaagcgtctgcacggttaggagtaatatctacttcgagtacgtagtcactcttgatattataatagtctttggcgagagtacccggaacagcttcagccggcaacacgatgattcctgcatgatcggtaccaataccgatttcgtcttctgcacaaatcatccctgtagattctacaccacggatttttgacttcttgatagtaaagcattcatcaccgtcataaagtttggtacccaaagtggcaaccactactttctgtccggcagctacattcggagcaccgcatacaatctgtacaggttcgccgtctcccagattgacggtagtgatatgcaaatggtcggaattcggatgttcttcgcaagtcagcacttcaccgattacgagtccttccaaaccacccttaatggtttgcacttcttctacaccacctgtttccaagccgattgaggtcagcgcagcagccgtttcatcgggggtcaaatcaaagttgacatactctttcagccagttataagagatattcatataattaaatttttattgtttctcaaaaagtttcgcaaagttaataagatttttcggttgacatagaacgatttgagagaaaaatgtcaagagaagctaaactaacaaggacctgactgtattattccccaataaattcatggttggtgacaaagtggcaaaaaataaaggggtattctttgtcatttttgccacctatccccatcagaatacaacccggctatactctataaaaaataatcgaccgctcgattggagtaaatcgagcggttattttcatctgactaagcggtcatttctattcaacccaaacgaacgttttttagaaaggtaacggtccttccgttgcaccgaacggattatttccctgcggaacaaagtccggttccggcggaggcggaggcatagcaccggcattcagtttagaccccagcatggcacctgcaggttcacccggcatcggtataaccatatcatcttccggattagagaatcgtgtaaactcacctttgaatcggagcaagacttcacctaccgcaccattacgatgcttggctatcacaatttccgccataccgcgaaggtcgttaccacgatcatcctgataaatcttataatattccggacggtgaataaaacacaccatatcggcatcctgctcgatggctccggattcacgaaggtcactcaactgagggcgtttaccgtcaataccttcacgactctccacaccacgattcaactgcgacaaggctataatgggaatgttcaactccttcgccaatcctttcaacgaacgggatatcgtactaacctcttcctgacggctaccgaatgccataccactcgcattcatcaactgaaggtagtcaataataatgattctcaccccatgttcacgcaccagacgacgtgctttggtccggagttcaaacacagacaaagacggagtatcatccacataaagcggagcatccagcagatctttcagtttgtagtccaactgttgccactcatagcttgccaattgtccacttttgatcttctcactcggaatctcacaaacattggtgataagacggttgaccaactggacgttactcatttcaagagagaacaacgctaccggattccgataatcaacagcaatatttttagccatagaaagcacgaaagctgtcttgcccatggcaggacgggcagcgattataataaggtcggagttctgccaaccggaggtcatcttgtccagtttcgtaaatccactttcaagaccactcagaccgtccgttcgtgcagccgctttctgaatcagcttatacgcttcgtcaattaccggattaatctgcgtatagtctttcttcatattctgctgggaaatctcaaacagcttgccttccgcctcctgcatcaagtcgtccacatccagtgtctcatcaaaagccttgctttgaatattactggtaaacgttatcaattcgcgcgccaacgatttttgtgcaataatacgggcgtgatattcgatatgtgcggaagaagcaaccttactgctcaactgagtaatatagaacggtccaccgacctcttccaactcacctcttttgctcaactgctctttgaccgtcagaatgtccaccggcttctgattaacggcaagatcagtaatggcagcataaatcaactgatgacgatgctcataaaatgactccgggcgaagaatctcactcaccagcgaataagcatccttctcaatcattaaagcacccaacaccgcctcttccagctccggtgcctgaggttggatacgaccataatcattgaccggttgtactttagttgattttgtgttacgggaatttcttctttgttcagccatctgcttatatacaattttatgatttacaatttatgatccccggcttttatacatagtaaaatccgaaagggatgacaaagatagaatataataatgaagaaaagataaggaaaaatgaagattttagtaactttgtcaccaatagcataaattcgcaacccataatttaaaattcaaaaataataattcagaacgaatatgatcactttcccaaacgcaaaaataaacctgggactctctattaccgagaagcgtccggacggatatcacaacctcgaaaccgtattctaccccgtcgctctcgaagatgcgctggaaatccggaccagccccgaagcggacaaaaagttctccctgcatcagtacggaatggagatatccggtaatccggaagacaatttagtggtgaaagcatatctgctattagataaagagtttcacctctgtcctatcgagatccatctgtacaaacacattccttccggtgccggactgggaggaggctcatcagacgcggctttcatgctgaaattactcaacgaacactttcagctgaatttatccgaagatcagctggaaatatatgccgcaactttgggagcagactgcgctttctttatcagaaacgccccgacctttgccgaaggagtcggtaacatattctcccccattccactatccttaaaaggatatcagattctgatcatcaaaccggatgtattcgtatcaacgcgggaagctttcgccaatattcaccctcatcatcccgaatactcgatcaaagaagcgatcaaacgcccggtaaatgaatggaaagagatattaatcaatgattttgaagacagcgtattcccccagcatccggtgatcggagaaattaaagccgagctatacaggcaaggggctgtttatgcctctatgagcggttccggttcttccgtatatggattgttcgagccggaagggactttacctgaaactgattggggaactaacgtattctgttttaaaggcaggctgtaaaagagtaacaaaaaacggtaccacgactcccgtcgtagtaccgtcacaacacaaacacaaaataaaacacgacaaaactactatgcaatcatacctgtctatgccggagaggcataagtaccatttactcatattcacatactcacaaacagatcaagctgattagcatctaataaacaaatcgaatgaacgatttgtttaaacttttatgttaattaaaacaaatatctttttactgaatgcctctttcacggagtttcagctgccaattccatgcagagcgtaaagtatcttctaatgtttctaccgctttccaacccagttcctggtttgcataatcgggattagcccataccttttcaatatcacctgcgcgacggcctacaatctgataattcaatttaacgccggtagctttttcaaagccattaatcagttccaatactgaaacgccgcgtcctgtaccgatattaaatacttctactttttctttctgtttttgctccaaaatacgacggattgcaatcacgtgtgctttagccaagtcaacaacgttgataaagtcacggatacaagaaccgtcaggagtatcataatcgtcaccgaatacacttagtttttcacggatacccatcgctgtctgagtcagataaggaatcaggttttgaggaacaccgttcggaagttcacccagcaatgctgtaggatgtgcgccaatcggattgaaataacgcagcaaaatagcattgatcggggcaccggaagctattgtatcacggataatttcttcattaatctgttttgtatttccataaggagattccgctttcttgatcggagccttttccgttacaggcaactcatccggttgaccatatactgtacaggaagaagagaacactatgccttctactccatgtttaggcattaactccagaaggttgattaaagaaaccaggttgttacgataataaagcaacggcttctctaccgactctcctactgctttgcttgctgcgaaatgaataatcgctttaattcctttatatttggcaaatacggcatcaaggccagcaaaatcaagacaatccagtttctcaaaagctgggcggataccggatactttctctatattgtcaacaacgtcagcactcgaatttgataaattatcgataatgattacttcgtatccactgttttgtagttctacaacggtatgagacccaatatagcccgttcctcccgttactaaaattctttctttcatataattttaaaatatggttagtttttcggttttcagtttgtttgaggtacaaatgtatggaaataaaatggaaatgcaataaactatcgcaattttattcacaggaagatacttacgggacgatttgagggcgttttggtatgataaaaaacatattcggtatgaacagatataaagaaaaaggccggaaacaaactgcctgtatgttgccatacgacagagtttccagcctctttatctaattatcaacttagtcttttacacgacgccagagaagcccatgaatgccattgccagcaaacctgcggtaatcaaagcaatcggagtcccctgcattcctttcggaatcttcaccagggtcatctgctcacgcaatccggcaaacaataccagtgccagaccaaagccaagagcagtagagaatgcgtatacaacacctgtcagcagatcaaagtctttctggatgaccaggattgccacaccgagaatacagcagttcgttgtaatcaacggcaggaacacacccagtgcctgatacaaagaaggagaaactttcttcagaataatttctaccatctgcaccagtccggcaataaccagaataaaagtgattgtctgtaagtaccccaatccgaaagcgtccaacacaaacttctgaatcaggaatgtgacgatggtagcgatagtcagcacgaaagcaactgccgcactcatacccatcgctgtttccaccttcttggaaacacccaggaacggacagattcccaggaactgcgacaacacaatgttgtttacaaagattgccgagataaatatcaatatatattccatattcttttcttatttaatagagttaggctttcttcagactattaataatggcaatcagataacctaaagcgataaaggcacccggagccagaacaaagatcagcattccgtattcttccggcagaatggtcagattaaatatcttacctgttccgaggaattcacgtacggcacccaacagagtcagggcaatggtaaagccaaatcccataccgataccatcaaacatagaggccagcggattgttcttcgctgcgaaagcttccgcacgtcccaatacgatacagtttactacgatcagcggaatgaaaagaccgagggtagcatacagatcgggcacgtatgcttgcattatcatctgcaacagtgtcacgaatgacgcgatcaccacgataaatgaagggatgcgtaccatatccggaatcagattcttgatagatgaaattaccacgttcgagcaaatcaggacgaacatagtggccagtcccatacccataccgttgattgccgatgatgtcgtacccagtgtaggacacataccgagcaggagcacaaaaataggattctctttgataatcccgttcatcattactttaaaattattcataactgtctcctcctttcttagttattagtgtcattagcagctgcttcaccttccggtgcaacagccggttcatttttctgggaagctccggaattcgtatccacctcaccgcctttatatgcctgataagcagcattcaccgcattcaggaaagcacgtgaagtgatagtagaagccgtgatagcatctacctgtccattcatgtctttggtcacagccaatggagtctctcccggattcatgcccaaaatagactttgcactttcttcgtgagataccggtttttcgttctttgcaggatcataagctccaaaccatttgtccgctttcgaacccaatcccggagtttcagcgtgcgccaataaagagtagttataaatcttgccttcagcatcaaagcccaccagcactttcagttcaccgccaaatcccattgacttggcttcaacggcagaacctacccacttttcgccattcttggccggatagataatgaaatccacgattttctttccgtctttctcgctgaaaacagtatcgctttcggctaccggattattggtatattcaggaagcacctttttcaaggcctcgttcagcgtctttgcattcgcttcggcaatagggcctttcgtcagttcgttcacataagccagcaacgctacggaaacagctgtaacgcccgtaagtaccagcaacatattctttaaagatgattgtaactttttcatttcttcttcgctacctccccaaagcgtttaggtttacaataggtgttaatcagcggagtgaacgcattcataatcaggatggcgaatgacataccttcgggatatgcaccgaacagacggataaccaccgtcagcagaccgatacaaacaccgtaaatcagcatacctttcttgctcatcggagaagtcacatagtcggttgccataaagacagctcccagcatcagacctccggagagtagttgcaatatcggagaaacatacttttcgggatccaccatgtgcataatgcctgcaaatacaaatacagtcacaatgatagaaaccggaatatgccaggtgatgatctttttccagagcatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgccagcggagtagcaccggtggtagcgtccatataagatgtcagctgacctactaccggccatgttgtcatctgcaccgggaaagaaagcaacaggaatacacgtcccgccaatgccgggttgaatgggttgcagcccagaccaccgaaagacatcttgcctacaccgattgcgaacagtgcacccagaatgataatccagataggcagattggaaggtagattgaatgccagcaacacacctgtaatgacagcagaaccgtcacaaatggttgtagcaggtttcttcattaagaatttaacgatcgcccattcgaagaataaacaggctgctaccgaagtagccgtgacaatcagagcccccagtccgaagaaataaagcgacaccagaaaagccggaatcagtgcgatcagcacaccatacatatttttctgtacgctgtctccgccatgcacgtggggtgatagtgatacgattaatttattttccatacttcgttattttttagcttgacgtgcacgaatcatagctcctactttacccttacccaagcggcagtaatcaagcagcggacggttggcaggacaagtgaactgacaggaaccgcactcgatacaatccatgattctttctttttccattgtttcaaaatctccgttttcggacaaagctccgagcaagtacggctccagtcccatcggacaagcgctcacacactttgcacaacggatacaggtttgtgcttcaccacgtttggcttccttctgattcataatcaggataccggaactgccttttgcggtaggaacttcgatattcatcagagccttacccatcatcggaccgccaccgatcacttttcccgtatcctccggcagaccgccacaagcatcaatcagctgtttcatcggtgtaccgatacgcgccaggaagttggaaggtttggccacagacttaccagttacggtaatcacacgctcaaacaacggtttatttttctgaacagcttcataaacagcaaatgccgtacccacattctgcacaactgccccagtagagataggcagcgcaccacttgccacctggcgtttggtaatcgcatcaatcagctgtttctcaccaccctgaggatatttcactttcaaaggaacaacttcgatgcctgcataactggaagcaactttcgtcatcagttcaatagcatccggcttgttattctcaattccgataaatgccttatttaccttcacggctttcatcagaatggagacacctaccatgacttcttccgcgtgttccagcatcagctgatggtcggcagtcagatacggttcacattccaccgcattgataatcacacattctgccttgaacgaaggaggcggacaaagtttcacctgtgtagggaaacaagcaccacccaaacctacgataccggcatcggcaatcttcttcacgatttcttcggacgaaagctcacattctttgaccagtgtcttgctacggtcaatggtttcttcccattcgtcgccttctacatcaataaagatagcaggttttgcataaccgctcgcatcgactactgtatcaatcttcgccacttttccactgacagaagagtgaattgctgccgaaacgaagccggcaggttcggcaatcttcgtgcctaccttcaccatatcaccttttgctactatcggtttggcaggtgcgccaatgtgctgccccaacagaataactgcctttgcaggaacttccgctgtgatgataggttgatgtgccgacaatttattttcgtgtggatgaactccaccaattgaaaatgtctttaacatacaattctgtattttattctgttattattctgttaccttcggagcttctgcagcaactgttttcggtgcttcttccgccttcggtttacgtggagggaagttcagctcgataattgtgttctgcggacaaacttccacgcacttacgacatgatttacacttgttcggatcgatgtaagccaggttgttctccagcgtaatggcttcgaacggacaagtcttgacacacttaccacagccgatacagctcactgtacaagccttacgtgctacggctcccttgtctttgttcacacaagagatgtacacacggcgtgatttcttgccttgcggacgaatctcgatgatcgccttcggacaagcctttacacaagcgccacaagctgtacatttggcttcatccacttccggaagtcccgtttcaggattcatgtggatagcatcgaactggcaggcagccacacagtcgccacatccgaggcatccgtagctacaacctgtttctccaccatacaatgaagcggcaatagcgcaactcttcgcaccgtcgtattgattaatacgcggacggttggcacagcttccgttacatcttactactgctaccatcggttcagcttcagtagctgccagtccgagaatatcagcaatttgtgccatgacaggctgaccgcctacagggcagaatttaccatccagcgaaccggctttgacgcaagcatcggcaaatccgctacaaccaggatagccacatccaccacagtttgcctggggcaacacttcccccacctgggcaatccgcgggtcttcatacacggcaaatttcttggaagctacataaagaatagcggccagcacgagcgctatagctcccaatgaaatcactgcaatcagaatcaaattcataatgttttagttatttattggttttatagtaaatgaaaaatgttgtttcattcgcgttttattgagccacaatacgaaataataaggaataagaactgccagagaaagaagagccgcatacagttcattccctatcaacgccatccatgcgaacagggaaacaatcagaagtacaaaaggaattatgaatgcaagggttacagccatcatgcccatcgacgtttcgccgatcaccatcacccgctctcctacctgataggaagcagctgtaacatccgttatatctatgattttgtctttactatccgccgaagaacagtgtccttttgcgctacaagccgcacaagccgacgtctgaacgattctcaccgacagatgagaaccctgtatgttttccacaatacctagatgctttatagtattattcgtcattttgcaaactcaacattacaaatcgcggcaaatttaatcattatttgtgaactacgaagcattccctcatttttttctacataataaaatgttattttttgtgttttcgttatcgcacacgaaaaagtaacgccaactatttgatattttagcatacaacaaagcaggcgggaaagttcttcccgcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagcaatgattactttcaaaactacactccaagttttcttcatagatttttcctcctttctttttaagcttttcagattatacagtcggatccggggcttcctcatctcctccttcatttccaccaccgccattttcaccatcatccggatcattcggagtcacagaggcattcaacttcttcagatattcatccagactgatcaaatccagtttttcatctgcacgggtagccgtcttcgtgatacgcagttccttattcgcctgaaagaagatgcgtacgctatccacacttttagcattgacatctttcgctgcatccgcccctttcgaacaagcagtcagcataaatacacccaagccttcgatattcacagacttaccttccagaagttgctctttcattttctccacaaaattctgaatcacactcttgatatcaccgatggataaagaagaatagccctgcattttctgcgcaatatatttcagattgacagactgacctaaagtgatcagatgcggataatatttcttgggagaattgggaacacgcgggtcagatggtcgcgtaacaactttgtaaattacactcataatacgtttttttaaagattcaaattcaagttattttattcacgttttgttgatcaacaatgcaaaggtgaggcttttatttcagataacaaaaagaaaagccccttgcggggctctttttctgagaaaagttataattcatagatattcagatatttatctttttgtatcttgaccatatccatagccgtaaccataacgtttaccatagccgtagtgtttgccatacttaccgtagccgtagtaataaccatattttcgcttcttcaggtctacgccgttgatgacggtacaaagattaggcagcttcttctcaaaagacagttcattgatcaatgtatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccttatgagtgtagtcagcacggcatacgtaaactgacaagtctgctacacgacctattaataaggtatccgttaccatgccgataggagcagtatcaaggatgacataatcgaagttcttcttcaaggtttctatcgctctgtccagaccgttacgagccaacagttccgttggattaggaggaacagtaccacccggaagaataaacagattcttattcacatcagaaggttgaacaagttccatcaaatccgtctcaggattggaaagatactgagtaatacctctctccttattagagagctggaatactttattcaaccccggcttacgaatatcgagtccgacaatcaccactttctttcccaaaagagaaagactgatagccaggttcgacgaaacaaacgattttccttcaccactgacagtcgaggtcacaaggataaccttctgatcattatcgagcataaactgaagattggttcgaatattacggaaggtttcactcatcagattattcttgttctcgaagacagcgatagaaccattcttatcattcttctcatcagttaatggaatatcaccgacaacaggaacactcgttagtttctccacatcggcacgaccttcgatcttgaatttcgtcagttcaatcaagtagatgataccaaccggaattccaacaccaagcatcaatgcaatcaaatagatcatagagcgtttgggagataccgggatatcatcagctatcgcttcatcaatgatcttcgcattattcgcagtggcagcaagcgcaatagcattctcttcacgtttctgtaacaacatcagatacaatcctgccttgatctcctgctgacgggcaatactcacataagcacgttcctgacccggagcgttgctgatacgacgggaataacgactcgcttcacggtcaaggctctctttggtaatcatcagtccctgcaaggttccttcaagggtagcctgtacattggctttcatagcacggatactcgtatctagattcacaatcgtgggattattttctgttgatgtgcgtagcaagcgtttacgctcaataagcatttcgttataacgttcaatggctccaatcaaggcagcatcctgtaaacctacattactcggcaagacttcgtattcattgcctcgcaaatacttacgcaagtcattcaccaaactgatttgagtacggttctctacgctcttcttttcatactcagcattaccagctaaggctatctgagcttcactcgtcaaatccgtgatacctgcatcacgcttgaaagattccaaattagcttccgtactacccaattcttttgagataatgccaatacgttcatcaataaattccgccgtcttctgagcgatttcgtttttatcattgttcgtattgcgattatacatttcaagcaactggttgataaagtcctgtccacgctgcaaactggagttcttcaacgaaattacggctacagaagtagtcttagaagtaggggcaatagacaagtttttacaatagtcttttgccactctcatcggtttgtttattgtcgcagttatatggcgtatattcttctctatccgaggaactttcgttccatcctgtaaagttaccgaatcagccgcctgaaagaaggccagcgtgccttcatcagtcggaaagatagcaggcaacttctcaaaatgcttctgataacccttctcacctacagtcacattcacatccatactaccttcaggctgtaaggtcatctccaccatcattggtacattcaattcttcagcctcctgagatgtcagactcacctgcaccggagaagtcttatataaacctttagcaggaaattcatcctcatctttataagttatatacaatcccaactgattaacaacctcttttacgagtgttttcgaacgtaaaacttccaactcgttatcaatatttttagaagaagtcatcacaccacttaaccccatatcctccaattccgaagaaagtcctgcacctccacccttcttctcgtcttttatgagaacagtggcggaaatattataaatgggggtagcccaatgcaaataaaaccacgcgccaacaaaacatagcaacactgcccctacaaaccagggccaatgaataatatacttaaaaagaagcgctcggaaatcaatctgatcctcagtcaattcacgttccttcacgttttgattttcttccttcataaccctttctttttatttcaagatgttaaacaataaactggcaatagaaacaaggattgaagtagcagagaaccacaagcttgtactagttccgatatccgaatttcgtgctttcgctttattaggcgtcacgtagatgatatcattctgctgcaaataataataaggagaaagaatagtctccgccttattcaggtccaacggaataatttcctgcttaccattggcgttctcccgtatcagcttaacatcatcacgcaaaccgtatacagtcatatctcctgccatagctaaagcttccagaatgttcactttttcattagaaatcgtgaacgtaccaggacgggcaacttcgccgattacggaaatcttataattcaccatacgtactgttacaataggagtttcttttatataaggtttcagcctttccacaatcatttgctctgttgctttcttcgttaatccacccacatgtagttcacccaacactggaaaattgatattaccttcattatccaccaagtactgttgtaagactggctgagtggtggcataattcaaagccatattattctgcgttgcaacagtcaaattgaaaggcgccgccaattctggactagtacatgacaccacaatggttaacaaatcctttggcataatctttgcatcgtacagttgttcattctgggtactatacagtactacttctgcatcctgcaagtaaggtacttttttgtaagactggcaggctgttaacagaaaagctaccaataggcaatagcctagttgtttcattttcttcatatatttctttctattgtttttaatactataattataaattttatttactcctccatagataacttcttccaatttacctgcaagacacgttacagcttctccagtattttcatattgataaatagacacttccgtttgtgcctgcaaagcattcagcattcattgtaatgtgtcaaattacataagtcataattacaacgcaaggatggcaattcagccgcctgagttaataacccttttggaaaatctttatcaatcatcttttccattaattattgaactcaaaaactcacatcttgtcttatctgtcctctgtacctaaaagaagtatgcacataatccccctattactacttttttcattggagaatctaaatgagattagagggactttacgatatctacgaagttctcgataacatactctacatcctcctctgtcatcttagtgttaagtggaagtgtcattgtattctcgaacatcttgtaggcattgggaaagttcttaatgtcgaaaccgagagtcttataggcagtcatcataggtagcggcttgtagtgcacgttggtagcgatgccacgttctgccatcttagtgataacatcgttcacctgctcacgagtcttgcctaacaaacggatgatgtaaaggtgatgacttgaacaatgctcagcccctttatggtcgagaacagccacattcagttccttaaaagcctcattgaaacgctctacatacttttgacgtttctgaagcattgtatcgtaacgctccatctgagccaaaccaagcgaagccatgatgtcggtcatattacatttataccaagggccaatcacatcatactcccatgatccgagcttagtttttgccaaagcatccttgttctgtccatggagactgaacaactggcacttgcggtacagaaattcattccatgtctctccctcgaagacaggaatagtagtatctatatccattattataggttcgtttccaaatggtagatgccaagtaagtgcgccaccttctgccgtagtcaaattcttaacagcatggaaactgaaggaagagaagtctccaatctcaccagccatcttacctttccactcgctaccaaaagcgtgagcacaatccgaactgattatcacacgcccaatcttcttctgtaattcattagtaggacggaacaaacccttcttctgctcaaggatctccaaaatcttgtcatactcacataccacaccacctagatcaacaggcacaatcaccttagtacgttctgtgatagcctcagccaacttttgtagatccatctgctggttttcctcgttgctatctaccatcactaagtggcaccccacatgctgagtcacacttgcactagccgtataagtatatgcaggcacaattacctcatcctcaggccccactccaatcagacgaagcgcaagttccatagcagctgttgcagaattcagacatacagtcttatcagtatgtacgtatgccgaaatcttcttctcaaattcttttgtcttaggaccagtagtaatccaaccactcatgatagcctctactaccaatctcgtttcagtttccgtcatatctggaggactgaaaaacacgttcctttttttaaaatcagtactcattttactgtatgttttaaaagttattgtttatctttcagtaattatcactttgaatgtcataaagatcagcttaatgtcataccaaaaactagcgttctcaacatactccaggtaaagcttgatcttctcctgcataatcacattgatgtagtaatcctctggggcctcagccttttccatcagttcattctcattacggaacttgatacttgcaggatctgtaatacctggacgtacatccaacacgtgcatctgctctgaagtccaataattcacataatagcgaacctcaggacgagggcctaccaaactcatgtcgccgataagcacattgattaattgaggtatttcatcaaacttatatttgcggatgtaatacccagagcgtgtaatccgagaatcacgcccaccaatagtcaccaatgatcctttgtccgcccctacatgcatggaacgaaactttaaaatacggaaattcttattgttcttgcctacacgcacctgacgatagaacacagggccttttgaatccatcttgatccaaatggcaaggactaaaaacaatgggcccaacagcacaagcccaattccactcgctactatatcaaataatcgtttcatataacttattattcattctcacaggcaataacatcgaatcataggcttatgtcctccgtactacctatcataacctttatactctttaattctctgttcctcacttctctgacaaataagaatataaccatttttctcagaggcaatatatccatctaaaccctgaaacacaaccttatttgtatcttctacataaaccacataattcttgcattcgtacacgtaaatgttaccaattgcgccattataaattcatctttttgaagtttatcatgtaacgaagcccaattaccaagattgctccatccgaaatcagcaggatgaatatataccataccaacctttgatacaggatacaggctccatgactgcataaacaacagagaccttttctacattcggaaaaatctctcgaacctttgaaatttctgaaacttctgaggcaataatagcatccatctcctctacaatacttggtttatacttactaatgcattctgtaatggtattggcactccataccaatatacctgtattccaaaaataattgccagcaacaagatatttctttgctgtttcaaggtttggcttctccttgaattcatttacgctatgaatcttctcctccctaaggaagactcgacatatccataactagtttcaagacaaaatggcttgatactgatagttacgatatcattgttcttctctgtataaattagcgcattctttataacacgcctgaactcctctcgattcatcactattacatctgtaggagtaacaacaagttagcgttagcttcttccttacagatactccagcaaatccaaacaatgcaaggaactacattgcgtacaacaggttcagctaagattagctgcaaatccctaagttgttttttgatgctatgtctaaaattctgttgaacaatattaggctagctggttatttcattaatgacagagttaagacttcgtctacacaattgctcgcatttattaatattcttcctttaatagcctcaagagcaaaaacttgcactccatgatcaacagcaaaatcaaaccaataattccactcatttgcattcaattgaaatgtaagcaatctgttaaaatcctgcctaaaaagagatactcataataatgctaggagcagatttttcctaactattaattccatttattggaaatcgtcttttcaaatagcttaatattttacttaagattatccttcaagtaatcgtttagacacaagatttgtttaggacgattgaatttattctcagcacaatcaacgcagttctttgccatcactttcatttcctcaggatgagatactgcatacttaatattatcttttaatccttcatagtctttagaatgggccaccaatccgatattgttatccttcacaatacgggccccctcaccttctccaacaaacataataggtaaagctgcagccatagaatcataaattttagaaggaactgctccatagatatttttgactaacggaatcagcgtcatatcagcctctttcaatcgaaaaggtaattcttctctagcaacgacaccatgatatataataccattattgggatgagaagctataaatgcttcaatctccttctgctcgccacctgaaccataaatatgaaattccatacccatctcagcaaaattgatggacttgcagatatcagcaaccccttgagcgaatccaagcaaaccagcataaaccaatctaacttttccatcattaatcttatgcaccttaatatctgcaaatcttgtaggatctactccattccgaaacagataggttttattgccaccgtgggaagcaatatgatcaacaatctcctgagattgccccatagaaatataagcccccttataaattctatgctcaagattctcaagaatatgataaagctttccttctgatatcgcacccaattctttcgcagacaaaggccaaatatcagagatatttgcaataaatttacaatgtgcgtgcttggctaaccattttccaacaagccctaacgtcaaaggaggactttcaactattaaataatccaattgcttactcttcagatagcgtaaagagaatagcaccataaatgagaaagataccatattccaaattctaggaatcaccttctttgtatttgatgcatagagccaatatcttttaatctctacaccatctatttgatcagtgcatgtaatcttacctctataatcatcaaatatcttccccatagggtaattgggcatacctgtgattatgcatacttcattaccacattccttaagaccatgaatcatttcatacaaacgattctgaggtgcacccatttctggtttgtagtattgtgtcaataatgcaattttcatttctgtatatttaataattgtttattttctatatatactaatagtagctttagctgcattctcccatgaatacaaattcttcagatgcttaatcctgtattgtatcttctcattattaatattactatcaatatagcgcataagtaattcgcatagagaagacatataggggcttgcgtttgttgctgtaacaccatattatccgaaaatatcggaagcaatttcacttgtgcagagagtgtagcactccctaatagaaagaatagagagattacaaaattcttattcatattaactacttttttatagtatacaatttttcaatttactttatgacgaacaaatatacaataaccactaaactaacttcttaaaaaagtaaaagagaataatgtttttatagcaaacattattctctttttatctaaaccctacttatttactagaagcccaactgaactccaaagtttataacacgctgattcatataagcatcaccagctgtattggtcttaatttcagggtcttgctgatatttatcataaccggtaaaagtcagtaagttataagcatttacataaaaacggacattgtctaagaacttaggtaatgctgtcttgggaagttgatagcccaagtcaacagtcttcaaacgaatataccatgcattaatcagccaaaaatccgaattataagcagaagcactatttattgtaccatcttgcattgtcaaacgtgggaactcaatactttctccattttcataacgttcctgtgtccaacgcttttggtgaagtggctggaactgactcttaccagactcaatccctgttccattgatagcaaaactataatcaaacgatccttggaataaaacactgatactaaaccctttccaacttcctccaatcgtccatcctaatgttgtagtaggcaagttcggtttgccaatagcacgtttatcaaaatcattgatagtaccatcaccattcaaatctgcatactttaagtcacctgcctgcacagcaatatcaggcttagccggagcgtccgcagcaccagaattaatcttttcaatatcttccggtgtataatagccaatccaatgatagccaaaaggctgcccaatctgtctacccgtttctctcaaccattcatatttctgttgagcctcagctttataatcgactcgatttttagcataaccaaatacaaaattggtattaaaattgaagttaccaaaacggtcttgataaccaatctgtccatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaaacaaattcatatctacaccaacattaaactttctcgctttctcccacgttacatttaaatttcctaaatcaccttctttgatgccactaacaccaaagttgttaccttcaccaaaagtataagaatcacctgttttatatacttgccgatacagataacgatcgccgcttgctacatctgaccctacaagaccataagaagttctaaacttcaataactgcacattccttcccaaccaatctacattcttgaaaaagtcttcttgagagatagcataacctatagccaatgctggaaagaatccgaaattgttatctttaccaaaacgatcggtcccattatatgccatgttcaaatctaccaaatatttatttttatatttatagcctagctgcatcgtataaccttcgaaattattgggaacagctgcatccttttcatttgttgtactctgacgattgtacaaaaacataacatttacatcatgtgcattattgaaaacatgagcatatttcaaagatgctttgatattcaaatctttgatagctttatctgtactgttatatacaaaatactgctcataatcatagactccattcggattgatattatacaaacctgttgcagaatcgtaatgataagtcggatatcgtgtacgcatcactgcacgataattttcatcactactggaatatgccaattgaaaatcagctgcaagccctggcgttaagaagtccatcttccatgttgcaccatacaaaatattattatcattacgtctagtacgtttatatccttcatttgccaaccgtgcgttcaatgtcggttttctatcttgcgtatcatataaataagcaaatgaaccatccggattcaaaagtggagccgaataagggtgcattttagagaaatcataaagctcacctgttacattcatattgtacggttcattgatatccatgaagcgtgaagaaacgtccaaacgcatattgaagttatcagtcacatcaaaatcaagattagtgcgataattgaaacgacgataggaataattaggattcacaccatcaccagaattacccccaaagtcttttaccaagccattctgagtaaaatatcccgcagaaacaaaatatctcaatttcttagaaccacctgagacatcaacatttatgttctcctgaaatgccattttcttaaaaatctcatcataccaattgacatcaggatgcccataaggatcagtatgatctctgaaagcgatcatatcgtcttcagtatacgggaaatcagacaaagtaccatcattcgtatgtgcttcctttactaattgtaaagattcgtaagcgttcagaaatttaggcgtacgaactggggtttgcataccagtttccaaacgtacattaattttcggtttaccttgctccccacgacgagtctttactactaatacaccattagcacctttgataccatagatggccgtagtagaagcatccttcaatattgatatactttcaatttcgttgacattaatttgagacaactgttcataagtatactgcatgtcatccaccataatcaacggtttattaccatcattattcaatgaactgacaccgcggataaagaagtctgaagcatctttacctggttgaccagactgttgctgactaaaaaaacccggcagctttcctgtcaaagcattctgtacactactagttggaacattacgaatctcacgtgcctgtattccactaactgcacctgtcaacgttatacgcttagccttaccataaccaacgacaacgacttcatccaaatttgtttgatcaggagccaattctacattcagcatttgctgactatttactttaatgctttgtttcttaaaaccgatataagaaaactccaatacagcacctttgtttacatttaattggaaattaccgtcaatatcggtaattgtacccactgttgtaccttgtatttttacatttacccccggcaacaactcaccgtcggctgaagagacaattcccttcaaaacgaacgattgaccgaacgccgagataaaaaggcttatacatactaatattaataatagtcttttcataatattaccacttcggattttgaatcatgttatcattcttaactacctcattatatgggatcggatataaatagcgtttcacatcaaacgtcgtacttaggacatccacttcattgaaactcgtagtatttccttttaccctaatctccaaaccttccaaaggattcttaaatatctcttcagcaattctccatctgcgaatatcccaatatcgttgttcttcaaatgccatttcaatacgccgttcgttttgaatcacttcacgcatctctgcctgtgtcatatttttcttaagcccataaggagattcatcattacctgattcaataccagcacgtgcccgtaatgcaatgatagcatcgtacacatcctgagaaggagaagaaaggtactcattcattgcctctgcataattcaacaacatctctgcataacgaaacataacccaaagatgtattttattcccatattgagactcttcaccaaatttacccataaacttacacatataatagcccgtcttagaatattcagcagagttagatggattattaactcctccgattgaaatatcaagcgtattattcaaccaagatgacccatgatgcagtattgtataatccaaacgtggatcacggttttcatatggattactctgattaagagtatatttactaccttgtccagcaaacatgccgtccttcatagggaaagcgtctaccaaattttgagttggaagcgtacgtcctttacctaaattgtcaccagaaaatcctaaaggcccattattgctttctatagacttatcttcaccccccggacgataaaagatgacttcaggattattagtcttattataaaaacctaaaaagacgtcacgaaaatcccgattatcgccatcagatgtagactgtgttaaaccatatgccccattaccattcggaccgtactcgtcaataaatgtcttggcagctttagccgcatcattccaacgctctctatcataagaagcatagcctatcaattcattaccaatctcaataggacgttcattaaataaaggactcgctgcatataatagcactcgagactttaaagctaagcaagcctcacgagtaggagtatgtgcatattgttcaaaatcaggcattggattggtacgcaaatcatctttaatatcatctaattcatcacaaatatactgtacacattgctcaaaagtatttcttgggatctccatatcatcacccaatatatgtacatcatcccccatcaaaggaacaccaccatagcgtttcactaattcgaaatagaaataagccctcaagaaacgcgcttctgctttcattgtaacattcaatggttttgtttctccctttgcgttcttataagtcagcataaaagggacaacatcaatatgattaatcagaatgtttgccttacggattcctgaataatactctttccatcgcatatccgattcaacacgtgtactcgcagtataccgtcccattgccaacttataaacatccgggtcagaaacatttatagatatagcatcatcagacgcagcatctaaataatcacttcctacacgattgtgcccgttttgcaacgtggcataaatattattcataaactttaccgcattcgtaccaagagaatcggtttttgaaaatacaaaatcaattgataccagttcaactggctctggttcatacccatcggtacaggatacagctgtaaacaacaatccaactccgattagcgtcaaatatttatttcgtatcatagatatcatagtatattagaatttaacattaatacctgtgctgatgcaacgttgtagcggatagttaccgaagctaacttcgggatcaacgagttcattagcagcttttgtgaataagttttgtccacttacgaaaactttcacacgtgctccacccaaataattacgacagaatgaatcaggtaagttatatcctaaactaacatttttcaaccgaatataattaccggaacgtaaccaaaaagaagagccccagccattgccttgattatacttattaccaccagcactcaacctcgggaaagttgcagtagcagcagtttctggagtccatcgatccagcatattctcatatgcctgtccataaacttgtccttgagtttgaaaaccttccaataaattccaatcactcattaaaacatctttattgtacactccttgccaaaacattgagaattctaatccacgccattcgaaacctaaatcaataccaaaataagagagtggtttatcgccaccaatcattaccttatcaaagtcattgataactccatcgttattctgatctttgtacttgatatcaccaggctgaatattgttaaatccttcaattacaggactctttgtaatttcgtcttgagaagtgaaaaaaccttctgctaccaaaccgaagattgcccctttgggtttacctgtagtacgcagatattcataaggcactttttgttcatctttatataacactttactttgctcacaactccagttagcagatgcataataattaaaatcgccaacgtgatcttgataggtaattgagaattcgcctccataccaacgttctttagcaatattttcatctggataattctggccaattagttcgatactttttccacgagcctgcaacaagtcataatatttatcattaaaataatcagcagttacctgtaatttgttgttaaacaaagctatatctacaccaatattcagtttattgcctttttcccacgtttgatataaatttgccagtttatctttttctgtaaaacttcctgaactttgtcctaaattagtccccaaccgataatcatcacctcctgaggaataagtctgataatacgtataatacccagcattattcataccattacctgtcttaccatacacaccgcgtatctttagttgattcagccactcacagttttccataaaattctctttgctgatatcccatcctaaaccgaaagcgtaaaaggttccccaccttctgcctggagcataacgattgtaataactttcacttaatgctacctgtgcaaaatatcgctccgcataatcataagagacatcacctataatatttgatggatattcaggaagatcccagttagtaagagtatttcgcgtatctcctagaacactggccttaaatttgtgcttaccaaattgacgttcataatcaacagcaagctgaccatacatctgccgataggtagacacagaactaaatgaatttgattgcgttttcttttctccataccgagtataaacgtcattgccatccttatcaatagtataatcaaaaacttcggaagtttttgttcgtttcgtagtcgaacgattctgagaagttacactacctaccatacgaacagacaagcctttaactaacttaccaaaatcatagcgcaaattaatagctcccaatacatcccgagccccatctgttatataaccagagttaatagtctgcgataacaaattattattgaacgactgactacctccccatgatccatctggatttgtcacaggatatgcattacttggagtagaataaattgaactgagaatatcatcatacccatttccagtccctcctggttgggtaccttcttctatacgtcccatcaaagtaacttttgctgtcaaatcatcagtaatattgatgttcactttagaagaaatcatataacgatcaaatgtcatatttgtatcgtgagcatctccacctggatttttaaataatccattttcacctacatagcctacactaataaaatattgtgcgtacttgttaccgcctgtagcattcaaattataagactgagtagtcgaatttttgttcatcagttcatcacaccagttcacacttggatgtgtatacggactggaatgatcacgaaacttaataaagtcatcataagaataaaagggatttttaccatcattcagcaacgcctcattcaataaataagcatattgagaagtagacagcggatttagttttttcactgaactctgcacaccaaaccgtccagtaaatgataactgaaatccctgtttgataggatctttagtagtaattactaatgcaccacgggaactgcgcatccccaaaaacatagatgacaaagcatccttctgaattgataccgattcaatagcatcaggatcgatagaatataattctctttgcacaccatccactaccaccaccggtgcattgtggcgtgatagaacattaaattccgtattatcactatatgcctctttacccaatgtagggctattaaagttaaagatggttccagaagaactggattcaatttgactcttacgtgcaccacgagtacgtacaatatctagtcctggtaaacgcccttgtaatgaaggaagaatagtagttcccatcaatgaactaacctgatctgtataaaccgtagcagctgaacctaaatagcttgctttatctttcgtatcataaggtccatttattacatctggaaatttcacgaactcttctgtcaacgttactttaaaaatacgttcctgatttcttagcttgttcaccttaatttccttatgtaaaaaacctggatgagaaaaacgaagcatatcgcccttcttatactgaaattcaaaagtaccatcatcacctgtcacagtcttaaaatcagtattcttcatcgtgattacaacacccgagacaggattgccatattgatcgattaccttacctgtaatattagccgttcctcctgcttcttgagccaccgcattcaaatgtcccaagccaagtagtagccacattacaaaacatgtgaaacagtaccgactatttcttttattcaaaatattacgcatataatctttttttaaggttaaactctattcacattgaaattcgaatacgaaaggctcttttattccttcttctacctcttctccttcattatctctactgtcatctgactgggaaatagatactgttccatcttcatttgtgaaaatatactctatacgagaaattgtttcaccgtccggaatgttaaaaaatccaccaggccaaagagttacattatatcttggcaatttcgtttctcttttcattagtgttttcgcactcttttcattgactgtatatatctttccttctatcgtataagcagtagcttctatatacacattctcagcttttatcaattcattggtattaatatccccttgaaaagtgaatgttacataatcatcttgtaaagcagacaaaggttcaatttgataatagtgcgtagaacaaaaatcaatcacagtacctgatccttctaccacttcaaagcaatcatcagcatccttaacagaataatgagcctcgtctcctccaatcccatcactagagtgattgataaaaaaacttggtcggaattttaagttgctttttcctgaattacacttaattgttactgtataatgtattgttccatttacactaggatagttatccgatttaaatgcaatccattccatatcgttcaagacattgcctcgtacaccatatttttttttcaatgccgctgaccaactcatacctttataatttgcaggctgttcagtatctggaattactgtcattttgtgatccacttccgtttcatacctatcttctctgtatgtcacagttgcattctgacgtacattccaacttcttggagccaagaatccaacaataaacgtttcattgcttgcatcaccatcgatgtttatttctccactaaacgtaaaagttgcaatttcaccagccttaatataggcaaccatctctccggcctcgttctcttgtttaacatttacctccttaatcaaaaaggaacatccaaagactattaaggaaagtaccaacaaaaaaaagatttttattctatgttttttaaaataatatttcataagcttttctttttaaatcattcttctattttttcaaaagaataaacataagagttgctcgagcatcccggactaattgtaagggttatatggcgtttcccttgtacaatcgggtaagtgatttcagttatagcttctctttcagcaccttcctcctgaaaagttaagaaaaaaggatatgtcaaattatcaattctccatgtaccatttttctttactaaaaaagggagatagttttcaatattatatgtattatctttattcataatcagacgaaactgactaaagtccatcacttcagatatatccgttccattgcgtacaacagtttttaattgccacttcccatctaactgctttggtacttccatataagaatcaggagctatttcatctttaaatgtattgcaagcactcacagtaaaaaggtaaatatccgtgccatttccataaagaagtactattctaaaccctaatagaattaattccattagttttgtataaatttgtaaactactaaacttgttaaaaataaaccatgatgaacaaaaaagtaattgccgtagccctcgcccttgccttagcaggaggaagctatgcacaagatgacaccgcgaagaaaaaggtgaaagcctatatggtgtcggacgcccacctcgacacccagtggaactgggacatccagacaacaatcaacgaatatgtctggaataccattagtcagaacttatttctgctaaagaaatatcccgaatacgttttcaactttgaagggggagtgaagtatgcgtggatgaaggaatactatcccgaacagtatgaagagatgaagaaattcatcgaggaaggccgctggcatatcgccggaagtagctgggaagcaagtgatgtgttggttccttccgtcgaagcctccatccgtaacatcatgctcggacagacgtactaccggcaagagttcggaaaagaaggaacggatatcttcctgccggactgcttcggattcggatggacgcttcccaccattgccgcacactgcggactgatcggcttctcttcacagaagctggactggcgtaatcatcccttctatggaaagagcaagcatccgtttaccatcggactctggaagggcattgacggcaaacaagtaatgctagcccacggatatgactacggacgcaaatggaacaacgaagatctctcgaagaataaagatctggaaaaattagcccaacgtactccgctcaatacggtctaccgctattatggaacaggggatatcggtggctctcctactctgggttcggtacgttctgtagaacagggaatcaaaggtgatggcccggtagaggtgatcagtgctaccagcgatcagttgttcaaagattatctgccgttcaacaatcacccggaactgccggtatttgacggagagttattgatggatgttcacggaacaggttgctatacttcgcaggcagccatgaagctgtacaaccggcaaaacgaacagttgggcgatgcagcagaaagagcggcggtcgctgccgaatggttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctaaaacaattctcacaagtactgacttcttccgtcaacgccattgccggacagatggatacacgcgtgaaaggaacgcctgtcgttctttataatgcaaacgctttcccggtatcggacttgacagagatcatcctcgaacagcctaaaaccccgaaaggcttcactgtatacaatgcacaaggcaagaaagtcgcttcgcaaatgatcggttacgagaacggacgtgctcacatcctggttgcagcgtcactgcccgcaaacagttatgcagtgtacgatgtccgcaccggaggatctgaaaaaacgatctctccttcagccgcctcagccatcgaaaactccgtctacaaaatcacactggataaaaacggagatatcatctcactgaccgacaagcgcaacaacaaagaactcgtaaaagatggaaaagcgattcgcctggcactcttcaccgaaaacaagtcgtacgcatggcctgcatgggaaatcctgaaagagaccatcgaccgtgaacctgtctccatcacagacggcgcaaagatcactttagtggaaaacggcgcactccgtaaagcactctgcattgagaagaagtatggcaaatcgctcttcaagcaatacatccgcctctacgaaggcagccgtgccgaccgcatagatttctataacgaaatagactggcagtcaacaaacacactgctgaaagcagagtttcctctgaatatagaaaatgaaaaggctacttacgatctgggaatcggcagcgtggaaagaggtaataatgtacagaccgcttacgaagtatatgcgcagcaatgggcagacctgaccgataagaacaacagctacggtgtatcgatcctaaatgacagtaaatatggctgggataaaccggataacaacacgatccgtctgactcttctccatacaccggaaacaaaaggaaattacgcttatcaggatcaccaggacttcggcttccatacatttacttatagcctcacaggacataacggagcacttgacaaacccgccaccgccatcaaagctgaaattctgaatcagccgatcaaagccttcagcagtccgaaacatgccggaacactaggtaaagaatttgcttttgtacgttcaagcaacgatcaagtcgttatcaaagcgctgaaaaaagcggaagtatccgatgaatatgtagtacgtgtatatgaaacaggaggcgcagctccgcaacaggcagccatcaccttcgccggtgaaatagagaaggcagtacttgcagacggtacggaaaaagagatcggcagtgctgacttcaacaagaaccagctgaatgtatccatcgctccctacagcatacagacatttaaagtgaagctgaagaaaaaagctgatcttcaagctccggcatgcgcttatcttcctttggactatgatcgcagatgtttcagttggaatgctttccgcaaagaagggaacttcgaatcgggcaacagctatgcagcagaacttctccccgactccatcctgaaagccgacggcattcctttccgcttgggagagaaagaaattgccaatggtttgacttgcaaaggcaatgtacttcagttgccaaccggacattcttacaaccgtatctatttcctggcagcctctgccggtgaagatgcagttgctaccttcagcaccggtaacaactcacaggaaatcaccgtaccttcctataccggttttatcggtcagtgggagcatctgggacatacggaaggcttcctgaaagatgcagaaatcgcttatgtcggcactcaccgtcatgcttctgacaaagatgaggcttatgagtttacgtatatgttcaagtttggcatggatattcctaaaggagcgactacggttactttgccggatcatgcagatatcgtattatttgccgcaacgctggttaatgagaagtatccggcagtaactccggcctcggaattgttccgcacagccttgaaagcagacaatggagaagaagcgacgactaaaacaaacctgttgaaacaagccaaactaatcaaatgttccggtgaaaccaacgaaaaagaagttgcaagatatgccgtagacggtgatgtgaagacgaaatggtgtgatacaagcacggctcccaactacattgacttcgacttcggaaaggaacagacgatccgtggatggaagttggtaaatgccggaaatgaaggcagcgtctttatcactcatacctgcttcttacaaggcagaaacagtccggacgaagaatggaaaacgattgatgaactgagtgataacaagaaaaacacggtagttcgccagtttaagccgacttcggtacgttacgtcagactgctggttacacaatctacacaaaacaacagtctgaaggctgcaagaatctacgagttggaggtttattgataaaccgaaaataaaacagaagtaatatctcacaaacaaaaagaaggcgtatcaaaagtcaaaagtaactaaaccctcctccttcaggaaggaggagtacccgtaggaggggagtttagttactactgacttttgatacgccttcttttttcatctccatatctgtcattgacaataagaaaacgccttcaaatatatgcttccgcaaacacttgaaggcgttcatcatcctaaccaatacctatcctaaaaactattttttacctatttattcaaaacgatcggcctattggcagaagctttaccaaaattcttggcaggctttttgcccatctcaaattttaaagtactgccgttaattatatcatcgtacgtaatataacttttatgataaggtttgccattcagataaaccttctgaatatagatattatctttactattattcggtgcttcaacagtaaacactttaccaccacgcactttcacttctatctttttaaaacgaggactgccgaatgcaaacacaccgtcagacggattcacctgatagaatcccatagcagaaaggagataccatgcagacatttgtccacagtcttcattaccgatgataccgtccggctgatctgtgtagaagtcgctcatgatgaaacgaaccttttccgctgttttccactgttcgccggcataggtatagagataggctatgtgatggctcggctcattgccatgcgcatattgtccgatcagaccggtgatatcactggaagcaccttcacccatactgtcattgttcgtaaagaagctgtcgagcttcgatgtaaacggcttgtcaccgccaaacaggctgatcaatccatacggatcttgcggagcgaagaatgtatattgccatccgttgccctcacagaaatcgccgactccgtgaatagaacgtgccggatcgtacggagtacgccatgaaccgtcttccagtttcggacggatgaaatggatagaagaatcgaaatagttcttatagtaatgggcacgcttcgagaatgtctcataatcagccgtcttccccatcttttgtgccatagcggcgattccccagtcatctactgcatattccatagcgatggaagtagcttcgtggattttatcagcagggatatatcctttggccatcacgtaaggaactccgttctgcccttcataagttgctgtcgctttcatagccgtcaaggcttcttccgcatcaaatccggtaaatcctttcagataagcatctgcaatcaccggaacagagctatatcccggcatacaatttgtttcgccgctcatcaaaggccagataggaagtttatcctgttgccgataaatggaaagcattgaattaattacattgtccaccatttcgggctgaatgatagtcatcagaggattcaaggcgcgataagtatcccaaagggagagagtggtataattcgctttcttcgggtctgtgtaaatcatatcattcatcccccgatactcaccattgacatcacaatacaatgtaggagcgatcatggtatgatagtgtgcggtataaaacacacgtttggcagcctcatcgtctgattctacggtcatcttatccaactgtttgttccagcggtcactgctcatcttcaccaccttgtcgaagtcccagtgagaaagttccgcttgcaggttcatcgctgcattgtcacaacttacggaagaaatagccactttaatctttacttctttcacattgccgaaagtaagcacacttttcaccgattctactttcagttgatcccaaagtttgggggtattatcgtcataagccgtaaatttctcgatcttctgatcgctcttcagcacaaagtatacttttcgcgacgggctccaccctctgacataccgataaccttccactgtatagtcatctactttgcgaatatagctgtcgtatgcattggaaccgtttccttcacgcaggtcaatcagtatagagaccggttttccttcgggataggtataacgatgaaaacctacccggtcagtagctgtcagttcggccttgatattgtatctgtccagaattaaagaataatattccggacgggctatctcattgtcatgtgagtatttcgacgcataaccgtcacgtatatcatcctggttacctctgggagtacggatttcattgagaggcataatcagaatatcccccagatcggtacatcccgtaccgcttaaatgagtatgagagaaaccaatcagaatactgtcggaataatgatatcccgaacaccagtcccagcctttatggatattgttgggtccgagttgcaccatgccgtacggaacactcgttccgacaaatacatgcccgtgaaaaccggagccgatataaggatcgacatactgtaacaatccctcactctttgaatagtcctgttttgccactccgctcgttgccagacctaaaaagcaggaagcagccattaaaagtttaaatgcgttcatctgtatttttcttgttaattcgaaattgtttcatggtaggatttacttcatgaattatagttttcatgatgcaaatataaactctattccggaactatcaggctgtcgccagagtttaccgaatggatggcagggatatttactcttttggcaaaagaaaaaggacttgcactgactaaagcagttcaaatcctttccataaatttccttcgggaagaggggcttcgagctctatcagctcttttgacacgggatggatgaagcgtaccttccgcgcatgcaggcaaatactgccatcgggattggaacgcggagcgccatatttaaggtctcctttaatgggacatcccatttttgccaactggcaacgaatctgatgatgacgtccggttttcaagtctacttcaagcagatagtaattctccgaatgtccgatcagccgataattcagaatcgctttcttgctattcggcacttctttgtcataagcaaaactcttgttctgcttctcgttacgtgccagataatgcaccaattcaccttccggctctttgggggcattctttactactgcccagtaagtctttttcacttcactggtacggaacatctcgttcagacgagtgagtgccttactcgttttggcaaaaataacaaggccgcttacggggcggtccagccggtgtgtcacaccgatgaaaacatttccgggtttctgatacttctctttcaggtactgcttcacagtttccgaaagcggtgtatcgcccgtcttgtctgcctggacaatctcggaagcggtcttgttgactacaattatatggttgtcttcgtatacgacagtcatactgttcgattacatattcataccaccatctacctgaatcacctgacctgatacgtaagaagacatatctgatgccaggaaggtagcgatgtttgccacatcttcaggagtaccgccacgacgcaaaggaattttctttgcccattcagctctcacttcgtcagaaagagcagcagtcatatctgtcaggatgaatcccggagcaatggcgttggcacggatgccacgagagcccagttcttgtgcgatagacttggccaatgcaatcatgccggctttggaagcagcatagttagcctgtcccgcattaccgtgaacacccactacagatgccatgttgataatgctaccagctttctgacgcatcataacaggtgtacaagcgtggatgaagttaaatgcagacttcaggttcacattgattaccatatcccattgttgttcgctcatacgcatcatcagaccgtcacgagtgataccggcattgttcaccagaatatcgatacgtccgaagtccttatggatttcttctacgacctttgcagtatcttcaaagttagcagcgttagaagcataacctttggctttcacacccattgcttccagttctacccttgttttttctgcattttcgtcaatgaccaggtcagtaaatgcaatgtttgcaccttcggcagcaaacttcagagcgatagccttgccaataccacgggcggcaccggttacaatggctgtttttccgtctaataatcccatactaaaagttatttaattaaatttctgttctatgcagtgcgccaaacacaatgttggacacatatttatttcttgtttcttcgtccagatgagctcctatatgcccacggatataaggaacttcaattcccttcacacagtaatgtatcaaatcggcagtcatctccacatcatcaatgtgaaacactcctttcgcctgtccctccaacaacacagctttaaaaatctggatttctttcgcatcaaatttctttcgcactttttctacccgccatatatcacggaagaaataagcacgcagggttccattccgataaacgacctcctttactgcatccaatcgggtatatatcagttccaacagtttgtcgtccggcgaaatgtttttatcagccaccctcttcatcatatccgacaagatatccaattccgattctacaacagccaaatagatttcatccttacttttaaaataggtataaagcgttcttctaccttttttcgaagtgagggcgatatcattcatcgtagtgttctccacccccatctttgcaaaaagctggcgggcaacgtctactaacttggctttcgtttttgatacggtcataggttatacaaattgcacattgctgaatattttgagcaaaagtaattcttttctttagaccacacaagaaaacgcacagaatattaacatttgtatattaataggtactaaaaaaagttccatcaatacctctctcattttcagcacaatatagataattcgatcttttttctaaaaaataattggagaataatttgttttattcaagaaaagccgtacctttgcacccgttaaacatcgcggagtggagcagttggtagctcgttgggctcataacccaaaggtcattcgttcgagtcggatctccgcaacttactaaagaatcgctttttaagtggttctttttttatctctctccggtaagattctactgattacagttcctttattcacaaccccaatcttatattaaccacgttatcaacaaagttattaacaggttaattaattagtaacaaacaaattaactatataagagactcatttttaaacaagcaggatgtgacttgttcacaacctcaaaaagcaaaataagaatcacccgaatacaaaaaagatactacctcaaaaatcagtagtatctccttaattcttcttccgaaaggaagtacatccattcattacaatctatattacccttgtcttttttgccggttctgacgcccttctttcatctgtttctcacgttcagcctgttttttcacatagctatcgtattgttctttagtcataatcttcttcaactgggcatcataatcttcacgggacttcttcatttccgccatcttcttttcccgctcttccttagtcatcttggcagctttattatctttcgaacgtccgccctgattagcagccatcttttgcacccatgtaaggttgacatcctgtaattgttgcttttgatcttcattcaaagagtattctttcaccatacgctctgtcatacgttccgcacgggttttcggatccatctgttgtcttccaccctggcgatttccttgtgccattgccacaccactcatcagtagcaaagctaccatccaaaatacgattcttttcatttcttttttcttttatagttaatctgataataaaccgattgcatcattgcaatattatatttgaccagattaaaacggaaaggttaaatcacatcgaggagattaacaataaataactttatgtttattcttcccgaccgaacgagcggtattcaagcggagtaagcccggtacgttttttgaaaaaggagaaaaaatattcggtagactggaagcccagaaaaaaagaaatttcttttactgactgggaagttcccaccaacatttgcttggctttacgaagtttcagttcctgaaaatatttggcgggtgcatagccggtatattccttaaaaaccctgcggaaccatgagtaactgatattcagtctcatcgccagttcctccggatcaatattgccggatacattttcattcataagtatctttgcctgctcgatcttctgatcgacatcactcatctcgaagaccttattcttggaaatcgaaagaatcataccaatcatgtgaagtacgattccggaaaggtattgctgggcagatattttatccgcttctgccacttccaaagcgcgggaaaacaaagataccagttcttcattaataccgacttccaatatctgtctttcctgagaaagaaaggcatcgcccacaatcgtatcaatcgccggaccttcaaaaccaatgtaatattccgtccatccggtctgccgcaatggataataagtatgccactgtccgggaaacaacaccatcagccgacctttacaaacttgtctttcaggagtagaatcggaagaaaacaaaccgcgcccttttgtaatatagaccaattgatattcccgcaatactcttcctttttcggcattgaaatagtaaccggacggatgctccttcagcggataaggagaatcgggagggatagactgatagccaaccgtattcacccacagaccgaatttgcggtccatgtcattaactatcaagtatttaaattctaatcccaaattattatcctcagtcatacaggcgtgttttcatacaattgaattgaacaaaagtaggaattattttcaaaaaacacacgctaaacagtaaaaaaacatccagagcacctgtccagatcctccggatgcttataaaaaacaaaccttatacaattaaaatcagaatgctttccgatataatacttcaatctccgctactgacgtaggacgcggattaccacctgtgcaaacgtcattgaatgcagccaccgccaatgccggaatatcctcttccttcacattgatttcatgcaatttctgtgggataccgatactcagagaaagcgctttcactgcctcgatagccgccttcacaccttcagtttctgtcataccgtctgtattgacgcccatcgccttggcaatatggatatatttcggagcagccggagactcagcattgtactccatgacataaggtaacaacagcgcattggcaacgccgtgaggagtatcatagaaagcgcccaacgggtgagccatggaatgtacgattcccaaacctacattggagaatcccatgccggcaatatattgagcctgcgacattgcttcgcgggcaactgtgtctttaccgttatctaccgctgctttcaagttctgagcaatcatttcaatcgctttcagttcgaacatatcgctcatagcccatgcacccggagttatataactttcgatggcgtgagtcagcgcgtccatacctgtagcggcagtcagtcctttcggcatggaatacatcagttccggatctacaatagctacagcagggatatcgttcgggtctacacataccattttcttgcgtgcatcttcgtcgataatcacataattgatagtcacttcagcagcagttccggcagtagtaggcaatgcaaaggtaggaacagccttatgtttggtatcagccacaccttccagagatttcacatcggcaaaatccgggttattcacaacaataccaatcccctttgccgtgtcgatagaagaaccaccacccaaagctacgataaagtctgcaccggaagccttataggcagccacaccattctgcacattagcaatggtagggttagcctttacatcactataaagttcatacggaatatgattgtcatcaaatactttaatgatttcggctgcaacaccaaatttgataaggtctttatctgttacgaaaaaggctttcttaaagccacgtctggctgcttccacagcaattacactccggcatcctgcaccgaaataagaggtctcattcagaataatgcgattcatagttgtgtcataattttaaagttaccgcaacattctccatcgatagaaaatgctgcggtcgctaaagtagataaattcagtgattaatacaagtattatttaggaagattgaaagcaacggacatttctttcatttgttcctgactcataccatccggttcgaagcccatattcttcgcagcaatatagatcagcgccgacttattcagcacgtcaatctgatcaaaagcctgcatagcatcgcagtctacggcaaaaacaccgtgtttttcccacatgactacatcatagtcctgcaattccttgatagtggcttccgccaactctaccgaactaggcaatttataaggaatgatacccagacctctcggacagaacgccttcgtttcaggaatcatactccataacagattggttgccacatctttctgaaggaacttctcgcaatgagtcatggcaatcagttcgatcgggtgagtatggacagatgctttataaggagaattcttgctcagcaaatcattgtgtacgctcaggtgggaaggcagttccgaagtcggcgccaccgcttcgtcggcaatgatcacatagctggcgcaatcatctaaaatgcgaatcaccgaaccattttccatcggccagcgagccagatcacgcatgcgtttgttggttcctttgcaataaaagtaacatcctttcagataaggcaatgtaacgccaatggattttacttcgctaatcggttccatccgacggatttcatcgtctacaaactctgtgatatttacagtgatattaccaccgttacgttcagcccatcctttttgccacaagtatccggcaacttcagctaccttgtttacttctttggcaagtgccggacgattttctaaaattgatttcatatctatttattattaaaacaagttcgggaataccagtgagaagatcaagactaccaaaccacagatcaacactgtgattgttttggcagatactcctttccactctttcaggatgattccccatacattactaaaggttacgttcagcgccatcaggatacaccatgagaaagccagcaacacgggactttccgtgaggaagctcttacccatttccaatccgaagaactgcatataccacagcacaccggccaacgcacagaagacgagattgttaccccatacctttcctttggcatagtcaccgacagacttattagctatattctgctgcaggcagtaagcggcatttgtcatgaatccgcctaaagtcacgaggaagataacaggaagacctgcataaagtccatccacaccacctgccaaagcagcttccttgataggagttccggcatccagtcccaaagcaaagcaggcactcatcacacccgcaagaagtgctaccagcaaaccttttgtcaatgcaaagtcttttacggcagcccgtttttcttcttcgctcatattctgtgcacgcaagccaccggcataaccaatgatagcaatacccgccagcgtaatacaaactcctagaagaagaatcagtccgttaccttcgaacagattggttccggcgaagatggcaggaaaaagggttccgaatccggcacaagtacctaatgcgatactttgtccaagcgcaacacccagataacgcatggagagtccgaaagtcaatccgcctattccccataatacaccataaaagatgctcattccagcacctccggctccccacaagtcgaacaaactgcctcctgcgggtatccccagcagtgatcccagaaacgggaacactaaccaggcaaacacaccttgtactaaccagaagctttcccagctccattccttcacctttttaataggtacataggaactggactggcaaaagctaccgatggctataatcaacaagcctattagaatatccatcacttatcgtttagaagttacttccgcttcgtacttttcgatttctgcaatgaaatcttcgcctaccggaacgttgttcttcaagcagaacatatcccatactgcattccatggaagcgctttctcttcttcgagcagagccagacgctggaatccctgtccgttagcttcgtattcacgcagcttggcaatcggttcgagcaaagcgcgtgtcatacatttctgagcagcacggctaccgataacgtaagcaccgatacggttgatagaagcatcgaaatagtcgagaccgtagtgtacgcgttccaacgcaccgcaacgaacaatttcactgaacagttccattgtaggatcatccataatggttacgtggtcggaatcccaacgaaccggacggcttacgtgcagcatcaattcgggcacataaagcaaaagagaagatactttgtcggcaacactttcagtcggatggaagtgaccggtatccaaagttaccatcttattacgggatgcgccataaccgatgtagaagtcattggaacctactgtatagctttccagaccgataccgaatacttttgattcaatacagtctttcatgtttttatattcagtagcaaatatctgatccagagaatctttcaacaatgcacgatatttcatgcggtttacagtgatatccttgcttccgtcatgtacccaaagattcatgatacacgggtcaccctgcgccttacccatttcttcggcaacggcacgacaacgtttggtatgctcaatccagaactgacggatgccctcatccggattagacagtgacaaatcaccagatttcggatgtgagaaggaagtagagttaaaatcgagtttcatgttatgctctttaccccattcaatccagctcttgaaatgttcaggctctacctgatcgcggtctaccactttaccttgaaaatccccgtagatttcgtgcaggttcaaacggtgtgtacccggaatataagaagcggctttcagaatgtcggcacgcagttcatcaatattgcgagctttgcccggataattaccggttgcctgaatacctccgctcagtgcacctgcctgcacttcaaatcccgttacatcatcagcctgccagcaatgaagtgacaagtggaagtcctgcatggttttcagtaccttttcagtatctacacctactgctgcatagcgttcaacagcaatctcatacgctttctgaatcatttcttcttttttcatgatattctattattaaaagttaatattattctgtcgattattttttgattctccggaatttatcgaacgcagtttttaaaatggatataagccgcatcccaagctgccatatcctgtgggtgataagtcttcaacggaattgaacggcttatcaactgacgcataccggcaacatccgtcgcctctcccaccgtcattgcctgaatcatgacattaccgatagctgttgcctcagacggtcctgccacaaccgggatgccgatagcattagcagtaaactgattcaacaagtcattacggctacctccaccaatcacatgcagagtttcgataggacgaggagaaagcgcacgcaagttttccaacacctgacggtaacgcaaagccagactctcaaagatacaacgtactatttgtccacgttgctcaggaaccggctgcccagtagtccggcaatattcacgaatggcctgttccatatccgcaggatttgcaaaacagtcgtcatccggattgattaaactacggaatggttcacacgaatccgcttcggttattaattccggatagcttgtatctccccaattcagacggcaacgttccagcaaccacattccacaaatattcttcaaaaggcgaattgtgccttctacgccaccttcattcgtaaagttcaaagcctctgtttcagcagtgattaccggtgcatctgtttccacccccatcagcgaccaagtaccgctactcaaatatgcgaaattacgatcaagtgcgggaacagctgctacagcagatccggtatcatgtccggccaccgcaatcacaggaattgcccccaatcctgttatcttttgcacttcttcagtcaatgttcctatcttctcacctgggaagacaaaacgaccgaaattctcttcttgcagtccgactgctttcagcaactccggttccagacgttgcgtatgtgcattcactaattgggcagtggaagcaatggtatattcagttaccatcttcccggtcagcatatagctcaacgcatccggcataaacagaactttgtctgctgcctccaatgcactgtcatgattgcgacgcaaagtatctaattggaaaagtgaattaaaattcattacctgaataccagttttaccatatacctcgctacgagagatacgagagaaaaaggcttccggtgctcctaccgtatgcggatcacgatatgcataaggctggcgaagcaggtttccatcttttccaaggaggacgaaatctactccccatgtatctataccgatagaggcaatagattcgccacggtgagctaccaatttcaatccgtcgataatgtgacggtataatgcataaatatcccaatagaaatgtccacccacctcgatcaagtggttaggaaaacgattaatctcctccagatttaatccgccttcaataaaagagcctaagattgtacggccgcttgttgcgcccaggtcgactgcaaaaaagttctgtttcatggtattttgtctatatatttaaggtatccatttacctacattgcaaagataggcggttccttcctccttttccttacgcattttgatagaaaggatgtgcattttgacacaaatctgcatagccaaaccttacatcagtataaattttactttttatgcaaaaaaagcatgatttatgcatgttttctccgaaataatgcataattttgcgccattcttagaataattatacaatgaagaagaaagcaaatcggttagacgccatcaaaatgattatctcaagcaaggaggtaggctcgcaggaagaactactgcaagagctgaaccgtgaaggcttcgaactgacacaagccaccctctcccgcgacttgaaacaactgaaagtagccaaagctgcaagtatgaacggcaagtatgtatatgtattgccgaataacatcatgtataaacgttccactgaccagagtgccggtgagatgttgcgcaacaatggatttatctccctacagttttccggcaatatagctgtcatccgtacccgtcccggttacgccagcagcatggcttatgatatcgacaacaatgagttcagcgagattctgggaaccattgccggcgacgataccatcatgctggttctgcgtgaaggagtagccacaagcaaagtacgtcagcttttgtcgctcatcattccgaatatcgaataactatacttatattatatataaagaaatggacactcaacaaatagatgttatggtagccgacgcctcacatgaggtttacgttgacactattttggaaactatcagaaatgctgctgccgtacgaggaaccggaatcgcagagcgcacacacgaatacgtagcgactaaaatgaaagagggcaaagcaataatcgcgctctgtggcgacacattcgcaggtttcacctatatcgaatcatggggaaacaagcaatacgtagcaacctccggtctgattgtacatcccgattttcgcggattaggattggcaaagcgcatcaaacaagcatctttccaactggcacgtctccgatggccgaaagctaagattttcagtctgacatccggagccgcagtgatgaaaatgaacaccgaactaggatatgtccctgtcactttcaatgaactgacagacgacgaagctttctggaaaggatgcgaaggctgcaccaaccacgatatactggcagctaaaaaccgtaagttctgcatctgcacagccatgctgtacgatccgacagacccacggaacataaaaaaagaacaagaaagaaataacatttaatatatacagcactatggaagaaaagaagaaaaaagtagtggtggcattcagcggcggactggacacatcgttcaccgtcatgtacctcgctaaagaaaaaggttacgaagtatatgcagcttgtgccaatacgggcggtttcagcgaagaacagctgaagacaaacgaagaaaacgcctacaaactgggagcagtgaaatatgtaacattggacgttactcaggaatactacgaaaagagtctgaaatatatggttttcggaaatgtgctgcgtaatggtacttacccgatctctgtcagctcggaacgtatcttccaggcattggccatcgcacgttatgccaacgaaatcggtgcggatgccattgcccacggttctaccggagcaggtaacgaccagattcgttttgacatgactttccttgtactggctccgaatgtagaaatcatcacgctgacccgtgatatggcattaagccgtcaggaagaaatcgactatctgaacaaacatggtttcagcgcggacttcaccaaactgaaatactcttataacgtaggtttgtggggtacatccatctgtggtggcgaaatcctcgactccgcacagggattaccggaaacagcctacctgaaacatgtggaaaaagaaggcagcgaacaactccgtctcactttcgaaaagggagaactgaaagctgtcaatgacgaaacattcgatgatccgatccaagctatccagaaggtagaagagatcggtgccgcatacggtatcggacgtgatatgcacgtgggcgatacgattatcggcatcaaaggccgtgtgggtttcgaggctgccgctccgatgttgattatcggtgctcaccgcttcctcgaaaaatacacattgagcaaatggcagcaatactggaaagatcaggtggccaactggtacggaatgttcctccacgaaagccagtatctcgaaccggtgatgcgtgacatcgaagccatgcttcaggaaagccagcgtaacgttaacggtacggcaatcctcgagctccgcccgctttctttctctaccgtcggtgtagaatcggaagacgacctcgtgaaaacgaagttcggcgaatatggtgaaatgcagaagggctggacagccgaagatgctaagggctttattaaggtaacttctactccgctacgtgtttactacaataaccataaagacgaagagatatgattaaagcaggaatcattggtggcgcaggatatacagcaggcgaattaatccgtctgctgctcaaccatccggaaactgaaatcgtattcatcaacagcagcagtaatgccggaaaccgaatcaccgacgtacacgaaggactctacggagaaaccgacctgagatttaccgaccagttacctctggacgcaatagatgtactattcttctgtaccgcccacggtgacacgaagaaattcatggaaagccacaacgtgccggaagatttgaaaatcatcgacctctcgatggattatcgcatcaagagtgacgatcatgacttcatctacggtctgccggaactgaaccgtcgtgctacctgtacggcgaagcacgtagccaaccccggttgttttgctacctgcatccagttaggtttgcttccgctagccaagaatctgatgttgacaggcgatgtttcggtcaatgccatcaccggaagtaccggtgccggcgtgaagcccggtgctaccagtcatttcagttggcgtaacaataacatcagtatatacaaggccttcgatcatcagcacgtaccggaaatcaagcaatcactgaagcagttgcagaacagcttcgattcagagatcgactttattccttatcggggagatttcccgcgcggcatctttgccactcttgtcgtaaaaacgaaagttgcactcgaagaaatcgttcgcatgtatgaggaatattatgcaaaagactccttcgtgcatattgtagataagaatatagacttgaaacaagtcgtaaataccaataaatgtctgatacatctggagaaacatggtgacaaattactgattatctcctgtatcgacaacttgctgaagggtgccagcggacaagcagttcataacatgaacctgatgttcaacctggaagaaaccgtaggattacggctgaaaccttccgctttctaaaaacagaagaattatgaaattattcgacgtatatcctttatatgacatcaatatagtcaaaggacaaggctgtaaggtatgggatgagaacggtacggaatatctggacctctacggaggccatgccgtcatctccatcggacacgcgcatccccactatgtggagatgatcagcaatcaggtagcaacccttggtttctattcaaactcggtgatcaataagctgcagcaacaagtagccgaacgattgggaaagatttccggttatgaagactactcgctgtttctgatcaacagcggagccgaagccaatgaaaacgcgctgaagctggcttctttctataacggacgcaccaaagtcatttctttcagcaaagccttccacggacgtacatcccttgcagtggaggctacgaacaaccccaccatcattgctccgatcaacaacaacggtcatgtgacctatctccctctgaatgacatcgaagcgatgaagcaggaactggcgaaaggtgacgtatgcgctgttatcatcgaaggaatacaaggagtgggcggtatcaaaataccgactaccgaatttatgcaggaacttcgcaaggtttgtaccgaaaccggaacgattctgattctggacgaaatccagagtggatacggccgtagcggaaaattctttgcccatcaatacaaccatatccagccagacatcatcaccgtagccaaaggcatcggaaacggattcccgatggcaggtgtactgatcagcccgatgttcaagcccgtctacggacaactgggaactacattcggcggaaatcacctggcctgctcggcagctcttgccgtaatggacgtcatcgaacaggacaatctggtagaaaatgcaaaagcagtcggcgactacctgctggaagaactcaagaaattcccgcaaatcaaagaggtgcgcggacgcggactgatgatcggactcgaatttgaagaaccgatcaaggaattgcgcagccgcctcatctacgacgaacacgtatttacgggagccagcgggacgaatgtactccgcttattgccccctctctgcctcagcatggaggaagcggacgagttccttgcccgtttcaaaagagtactctaactgatatttgattaataaacagcgaacaaaaaagcagcctcgaacagaaaaacagttcttattcaggctgctttttgttttttcgcaatttaccgttacctttgtctgtaagaatacattaaaaaagaagcgcatatgaaaatagctattatcggtgcaggaaacatgggtggttctatagcccgcggcctggcaaaaggaagtctgatagcagactcagatatcattgtatccaaccccagcgcaggcaaactggagaaactgaaagaagaatttccgggcatttccaccactctgagcaatacggaagcggcaacgggagcagatgttgtcattctcgccgtgaagccttggtttgtggagtccgtcatgcgcgagttgaagctgaagagcaaacagacgctcgtatccgtagcggcaggtatcagttttgaagaactcgcacactttgtgatagcaccggagatgccgatgttccgcctgattccgaacactgccatcagcgaactggaaagtatgacgcttatcgcggcacgcaacacgaacgatgaacagaacctgtttatgctccgcctgttcaacgaaatgggaatggccatgctcatccccgaagataagatagccgccaccacggcactgacttcctgcggcatcgcttacgtattgaaatacatccaggcagccatgcaggccggcatcgaaatgggcatccgtcccaaagatgcgatggaaatggtagcccagtccgtcaagggagccgccgcattaattctgaacaatgacacccaccccagcgtggaaatcgacaaagtgactactccgggcggaattacgatcaagggaatcaacgaactggaacacaacggatttacctccgccgtcatcaaagcgatgaaagcatccaaataataccgcaaaattattaataatcaaaaaacaaccacttgtatgaatgaccaaattaaacagatcgcagaacgccttcgcggattacgtgacgtactggaactaacgtctgaagatatcgcccgcgactgcgacatatctgccgaagaataccggctcgcagagacaggacaatacgacatttccgttagtatgctacaaaagatagcccgtacctataacatcgcactggatactttgatgtttggcgaagagccgaaaatgagcagctacttcgtgacccgtgccggcaaaggagtcagcatcgaacgtaccagggcttacaaataccagtcactggcgtcgggcttcatgaaccgcaccgccgatcctttcatcgtcacggtcgaaccgaagggagacgatgagccgatccattataaccaccacaacggacaggaattcaatctggtggttgaaggccgtatgcttatcaacatcgagggcaaggaaatcatcctgaaccaaggagacagtatttattttaattcaaaacttccacatggcatgaaagcgctcgatggcaaaacggtacgttttctggccgtaattatgtaataacgttatggtagaaagatttttagcacagactagctttgcctcacaagaggatttcatcaagaacctgaaaataaacgtaccggagaatttcaacttcggctacgacgtagtagatgcctgggctgccgaacaacccgacaagaacgctctgctctggaccaatgaccaaggcgaaagccgtcagttctccttcgccgacatgaaacgctatacggacatgacggcctcttacttccagagcctcggcatcggtcgcggagacatggtgatgctgattctgaagcgccgctatgagttctggtacagcaccatcgccctgcataagctgggagcaacggtgatccccgccactcacctgctgacaaagaaagatatcatctatcgctgcaacgctgccgacatcaaaatgattgtggctgccggcgaaggaatcatactgcaacacatcaaagatgctcttcccgagtgtccgagcgtggaaaagctggtcagtgtaggtccggaagttccggaaggattcgaagatttccatcagggaatcgataacgctgcccctttcatccgcccgagacatgccaatacgaatgacgacatctcactgatgtacttcacttccggcactaccggcgaacctaaaatggtagcacatgactttacgtatccgttaggccatatcgttacgggtagtttctggcacaatctggatgagaacagcctccacctcaccatcgccgataccggctggggaaaagccgtatggggaaaactctacggacaatggatcgccggagccaacattttcgtctatgaccacgaaaagttcacgcccgcagctattctggaaaagatacaggagtatcaggtgacttccctttgcgcacctccaaccatcttccgctttctgattcatgaagacctgactaaatatgacttgtcttcactgcggtattgcaccattgccggagaagcactgaaccctgccgtattcgaaaccttcaagaaactgacaggcatcaagctgatggaaggtttcggacagacggaaacgacactgacagttgccaccatgccttggatggaaccgaaaccgggaagcatgggactgcccaatccgcagtatgacgtagacctgatcgacagtgaaggtcgctccgtggaagccggagagcaaggacaaattgtgatccgtaccagcaaaggcaaacctctcggacttttcaaagagtactatcgggatgcggaacgtacacacgaggcttggcacgacggcatttactacacaggtgatgtagcgtggaaagacgaagacggatacctttggtttgtaggacgtgcagacgacgtaatcaagagttccggttaccgtatcggcccgttcgaagtggaaagcgctttgatgacgcaccctgccgtcatagaatgtgccatcaccggagtacccgatgagattcgcggacaggtagttaaagctactatcgtattgtccaaagactataaagcacgtgccggagaagaactgatcaaggaattgcagaaccacgtcaagaaggtgactgctccttataaatatccgcgtgtgattgagttcgttgacgaactgcccaagactatcagcggcaagattcgtcgcgtggaaattcgcgagaacgatgagaaataaggcataaaacccatttataaaaaagccggctgcaaaggattgcagccggcttttcttttcactatctgtaagtatcggattctctaatcaattgataaagctccaaccatccgcttaatcattaggatgatagaaattgtattgttcactccatgcaggaattccggtaagcgttatatcattaccgttcgggctattatccttcaatacatttccttttccttcatcacacttccaatacccaatcaaaccatccgaatctccggatatctggcgtgacattccttcctgaatagcgttctctgtcaggcatttgctccaaagacgaatctgagctaattctacctgcatattccagccgaaactctgtgctaaagaaatattattgaatgtaaagtctcttgaatcggctttactattattcaatgtaccatctttatagagggaaatagtagatccgtcataagtataagcaatgtgataccatatatccggataccaaaattcctcactatcaaaatagtttccatccaactgacactgcaaacatggcgcaatcttttttgctccatccgcccaataacgcaataaaacgccattgaaagaaataggagccgaattgtctgcgaaaattaatcgtctgaaagcaatattggcaggacccacccaatctcctgtcggtctgcccgttgtattatcgaacttgatccaatactctatagtccactgagtaacaggtatttcgtttttaaagttcagactggttttatttgctgatttcaaaaccaccgctttctgtttattaggggaagtaagcagataaagaatatggtttgcgttaccaacaagtcctatcggtccggctacggaagtgatccgtaccggaatcgcataagcctcgttattgggggtggtaaacggctttatagtaagattaatgactggtgcagacacttcacctgcgggaatcgtaactgtgcgttcaaaacttctgaattcttccggcaaaagttcgtaagacgcttcatgctgttgattatactcatcaatgagttgctgatcaatatccagtgttacagttacatcttgatcaatagcacgaaccaaacggacggtcaatgtttttatcacatctccctcgtccaccaattgtgcctctatctgctgactaaacgtattagaaggagccgcttccgcaatatatactccattatcgatagttgacagttttgcatcgttgcatccggtgacaacagccaaagctgcccccagcacaacatatcttgaaaatttaatcatcttcataattatccttttttagttatgttcttgcaattaatgattagcgggattcagaacctgaataacctcacgcataaagaaatagtcattcaccggacgacaaagattaaaacggtaggcacccactccgccaatgcgggcatctactcccggacgatagtacatcgccattcccttcaatgaataagtcacaataccatcacgagttgtaaattccggtccgccatcccctttatgcttttcaaagtcctcacaccaaactgttttactaagaatcgtagcttcatcctctatcgaaccgaatttatttaataatctgtcaaaacgaccatccaaagcatcactatatccctcatccgacctacagtaataggcttgaaccacataataatctaataaagggcccgactccttgttcagtgtctgcggttctccgtcgaccatcaatatacgtccagttcccgatttcggtccgaattctttcgataattcatccaaaaaaatatgcatacggtccgaatttccactcagatttccggaatagccaaaattcggttcaaagtcgatatcgaatccatcatagttatacttattgattgaatcaataatcacccgcgcatatttacggatagctttttcttgtccttcttccgaagtgtcaccataattgccataccacccccaataagcagccatcgcttcatccttagagttgtactgtacgccatccacgatgaaatcattctcaacagaagcaggcgtatgacttctgcctatatctgtgatatgctgacaatacaaaactctgagacctttcttctctctcacttccttaaggtcacttttttgtgcttcagtcaggttgaaagcccctccccaaagagagacgatatccattgaatcgggaatacctctcaactggttgttcatattcgttccggttccggtccattcactgtaccagccgaaaacaatcggatgatcggatttcttatactctctcagtgccttataatagtcttcaccattgatattcaccggttcggtgaacttcggttccatttcagtccagtcgctgcactgtataaacatcagtgcacccattactccaaatatgatatataataatttcttcatattgttattcctaatttaagctattaataagtaccattttctttcattgcccaccaaagatcagttccattagaatcttttccattgctaagcatactgacggccgcttccacattcgccttattgttattgtattcacttcgtgtaaaacgaagacggcgttgtccgcgccccgtattacaatcggcattcatagattcagttgccgggaagattctaggatagcctgtccgacggaaatctgcccatccgttcatcgggtcgggataacaggcaatccatttctgggtaagtactctttccagtttcttcgcgtcatcagctccatcctcccacttgatcgtaatggacgactggttcgtataattgtttccggtatgtccggcaattaaattatccacataatttcccggtatagatgtagcgtcagccaaataatcatcggcacccgataccccaaattcctcaaaagacaatcgaactcccttttcatagaaagtcttggcatctccacccatattccagcctttcagtgctccttccgcacgcaggaaagcagcttcggcagcgtacattaccggttgtggcaatgttttgtcggtagcgataaagagtttgctatagttggcgtataccgtaggttcaggtatttctgccgaacccgaacggacacctacatacccaccggcagcagtctgagtctgcggagtaaaataagcaggacggcgaggatcgttatatccgttcatgtacgacacgaggcaggcattggctcttacttcgggccatccgctgacaatagcatatccattttcattgattccgccattagtcgtatcataagaactgtcgcccacactttccatcacacctccaagtacagcttcctgagccttggtctgagcatattccggttctactcccgagatgcggatagccatccgaagtttcagcgtattggcaaacttcagccacttcgagcagtcacctttatagaactggtctaccacagccaaatcttgatttacgccgaacgttgccgccgacttcagaatggtgatcgcattatccagatcgtcaaacatggcatgccatacagtctgctcattatcataaggggcttccgtttcgccggccttcatctgtgtgtaaggaatgggaccttgcaaagatgcgagcaactgcataccataaacacgggttaactgagccatggcataaatgacacctttcttttccgtagagttctcgaccagaaagaaagaaggatagatatagccgtagagtcttccccatgaactgtcattgtgcccttcggacgcattataataagcaaagatattctttccaaagctccagttagctgtcgcagtcacttgaccgctaaagctggcccacatacaattaatctcctgacaagcattctgttgcggacaagcatacacgttaaacatcgtagacagtaagttacttgccggtacttttgaaggctgataagggttggtattaaaatcttcaaagttagtagtacaccccgccatcatacatacgactgcgcttgctccgatatattttattatcttgttcatacctatttattatttaaaactgaaatttaacattgaatccgaaatttcttgtactcggaagcatataggcatcaaatccctgatagaagttagatgcagctgaagtggtcagttccggatcgaaaggagccttgcaataaatcatccataaattctttcctaccagcccaacagtcattccgaccttattgtcaaaccattttttaggcaatgtatagctaagtgaaagttcgccgagtcgtacattggtagcgctatacgtgtagtaagccgcagttccctgaatggtctgatagtaagtctgtgcagagactttgctctgattaatctgcacgcctcctgcgtcacgtacgtccgcgctgactttggaaacaccggcagcgtcaagtacggactgcgtctcactgataacaatacctccgaaacgtccggtgaaagtcatgccaagattaactcccttataaccgaatcctaaactccagcccatattcatcttaggcagaatagaacctaagtaggtttctttgttctccatagccagtccgacaccttcttcattaagaatgtagccattcaagtcacgtttgagcaagcgttgtccgtatacgtctcccattgatcctccgacacgcaaaatcaggcgggcatccgtatgtccataagtaagcggagacagttccggcatctggataggttgtccggtggcatagttgtacacaccgtcagccaaccgttttacccggttcttattccatgtcaatgtatagttcgtattgaaagagaaatctttccactgcttgttataacccaatgacatttccagaccttcgttcatgatgtttccactttggataggaatattagaatatcccgaagaaagcgacaagtccgcatagaatgtctgattataagtattggaacgataataagtcaagttaagactgatgtcattgaggatacgtgcgtccaaacctacttcccatgacttggtacgttccggtttcagtttcgtgttcggataagaagaggtactggtccagctctgtgtctgttcatcgtaagggtaagtaacggtagtcatgaagcggccgtaagagttacctacctcagtgtacgaaccgcgaactttcaggtatgtcagccaatcaggagcattaaacatactcgtcagaatggcggaaagtcctattgacgggtagaagaaagacttgtaatcggagaaagccagtcttgaatcccagtcgttacgtccggtagcagtcagatagatcatcgatttccaaccaatttccgcattggcaaagatagcgcgtgtctgatcatgccagccggactgttttgctttccatgctttattgaaatcgatattgtggacggcaaagaaattgataagtttcaatccgccttcatatccgatcatttcataacggctgtcactcagtgacacaccaaggttgacattgaccgaccagtcgttaaaactcttattcagtgtagcaatcgcatccgcatacgtgttctttgattgtgtagaggtgtcactgtacgttccacggtcacccgacaccagtgtgccggtagaagcgtatgccttataagtactacgattatcataattatctattttcacacgtcctaccacatccagccagtcgaacaactgatatttgagggaagcgttgatcatataacgggtcttcttattctcccgcaactggcgattctgtatccagtaggggttggcaagaccacttgaagtaccgccgtaaggccagtattgctccatcaggtccataccggaattataacgttcgaacatacgtacatcatcgaaattctcactacgagggaaacggtaaagtcccggcagaggattatagtaataaccctgcgacatcatattcttgtcattctgaagaatataactggcaccggcatcgagtgtcatcttgtctttcaggaaactggtcgtgttacggacagtgaaattatagcggttgtatccactgttgggcaatatattggtggtgttggtagtagaagccgacaaatacgcctgattcttcttgttaccggttgacaaagcaaatgagttaatgacattcgctccggtctggaagaagtcacgcggatcgtagtcactgtttacaatcggtccccagctatccaggctgttgggcaggttaccatatttgctctgcatctcaggcatcattgacaccttcgagaaagtagtattattggagaccgtgacagaagtcttgtccgcagaccccttcttggtggttatcagcacaacaccggcagcggcagcattaccatacagagctgcggcagaaggtccggtcagcatagagatagattcgatgtcttccgggttaatgtcggcagcgccatccgtaccctgctggtcatagataccaccgccacctccattcatcatgttatacatcggtacaccgtcgatcacataaagcgccagattggaagaagtgatagatttgacaccacgcatcacgacacgcgaagcacctcccgtggtattggacgaattaatattaacaccggccaccttaccattcagagaagagatgaagttcgcatctttcacagtagtcagttcatcaccgctcagctgctgcacgttgtatgacaatgccttctccgagcgtttgatacccaatgccgtcactaccacctcattcagttcctgcgtcgcatcctctagcaccacattggcaacatttccttttacgggtacttcttttgactgataacctacataggaaaatacaagaacaggattcgccgataaagtggaaagcttatagtttccatccatatcggtgatggttccctcaccggaactcttctcccggatagagacaccaatcaacggctctccattcttatcttttaccgtgccggcaataagtctttcttttctctgctgtgcaacgtctttttcttttgcagccagtactattttattatccaagactttatattcgatgcccacacctttaaagacttgctccagaacctggaatatattcttattagacactgacaccgacaccttgcgtttcaaatcgagattcttactgtttacaaaaaagccgaatccggactcaagttcgattttgtgaagcacttcctctatggtacaatcgtttgccttcaatgtgatggaagtcttttgcgcatatccatcggacgcatatgccagtccgaatgagcagacaatgagtataaatagtaacttcatagatagtgatattttccttgaagaccgcctaagaaggtttaatcctccaagaaattggacgatacaataattttgcataaatttgtaacgagtttaattaaaaaactagtagttatacttgtcgggaaacaagtagattcacgattactgggctcaatacgggaagatacgaccaatatcatcccgtatcttttttagtttcaagggtctttgtttttcatggcaataagcttttttgaaataaggttattaataacactaaataaaaatttctatcttcatcttctctttacttccttgtacactgttcagataacgccagcgtattttcgaagaagcttctatataattcagtatctgctccaggctcctgctcgtgaatgtcccggagaacaggtcatcatcgggcacattgcgtcgaacgataaattccacatcatatctgtctgccaaaatctccagagcatcctgcaaagatgtctgcttaaagacgataataccatccttccatgccagttctccctcaccggaagtagtatagagctccgtttttccactctgcgaataatagatcagcttctgaccgggtgccatagtaatgtactgaggcttctgtgcggtattattaaattcgaaatgcactttcccttctatcagagtggtagtaatctcttcggaatccctatacgcctttacattgaactttgtgcccaacactttaatcgcagactgatgggctgtggaaacaatgaactgtttctccgggtctttctgaacttcgaaataggcctccccgtccagttccactttacgggtacgggaagcgaactgactgggaaaagtcagcgtactttttccgtttacccataccattgttccgtcagcaagcgtcacttgcgtacgttgtccggcaggcacatatacggtctgcatttctacattttccttttgcagagtttgtatcagtatataacttaatccgaaagccaaaacaaatataaccgcaatccgcatcgccttcatcgtaaaagtgcgtagtgaaagcagcttgtcacgccccgttttcaactcatccgcatcctgccaaacaagtgcatcataacttttgcggagtgacataaattctttgagattagcggcatcggcatcaatccatgctgcaacttcttctttctccctttgagaggcttttccggatatatattttaaaagtaaattctgattcatattataagttgagttactttataagtaataaacaggagtatatttgctccccctttcatatagatagagaacttataaatgaatgtaatagtacagagttcaagaagatgttagttcaacgtcttaataattcacaacagaaaaaaattactaacgaagcaggataacgcttacagcgttccccgcttagccattatcagtgatccaaaacaaacaaatgtatggaaaagtatgatataaataaggtatacaccccataataataaatgttcatcaatcgggaatgatgagtacctccaataaggtatatatcctgactcttggaaaacctgcattaaaaaaagatatcgcaacgatatttgattatgcagagattcaagaatttccgaatactcgtgagcaagaaaaattctctcaaaaatggctcaattcttttttaaacagagagacttactaaatacgtcaagtaagttgtaatatgtaattcctattaatcaattaaatgaaaaaaggtacgaataaaacagataattatttcgaacgcgtaaaacaaagattacatcctcccaaatacagatattatttcttcgattatctgtattttaagggtgaacaatggagcaagaaagccttcagatgctccggtgcattcattttactggagtattggataatgatcgtagcttttccggcatttggattcacgagtgtaacccatcactttggagacaatgcggtcatattttatcaagtactgattcttttattgccttacattttcatattttttcgttaccgtaaagacagaaaaaaagctattatcaatcattaccgacactcgaaaagtagtggagtgactatgaccttcatcattatcctcccatttatcttgttcttttttgaattatggctattcgacaaactggaatggatagattgcaaattatggtaatcagcaataaacaaaaggaatatagttaggacaaaatcaaggaaacttatggacgactttgctaaactctagtattgaaattacataaaagtattcgtctgacaactgttgaactttcgtctgacagctgtttctttttcgtctaacaactgtcagacgaaagttcaacagttgtcagacgaataatctttcgcatattgcgggacaaaggattgtgaaacgatccttaaatttcagtaagtagcgagctagttcatccgtaaaacactaaggcagaaaaccggtcttgtcttcatcggttatttcccgaataactttacagggaacacctgcggcaattacattctccggaatgctctttgtcaccacactgcccgcaccgattactgaatttctcccgacagtgacaccacccattatatgaacgccggcacctacccatacattatcttcaatgacaatcggatgggcatagcacccgcccataagacgttcctgcggatcgagcgcatgattggccgtatataaaccgacacggggccctaataatacattgtcgcctatcgtaatgagatttccgtccaacatgatgcaatcaaaattggcgaagaaattattgccaatactgatattgaatccaaactcacaccggaaattcggttcaaaatgaacactactgccaatacacctcaatagtttacgtaacaatgcctcccgaacttctttaggctttccataagtggaattataatcattggtcaggaaaacagcctgttctcttctttgaaccagttctacagacaagtcattatacatttttcccgaaagcattctttcacgcaattctttattctccatatatatattatgatgttatttaataagcaggacatacttgcaaatatacagaattagtcagataaaacaggcaacctattggttttcaaaaatacttttataactttggcaatattaaatataaacaatacaataaacgtatgaatctagtttcactcagagactcacctcagtatctggaaagagctatcgcctatttccaaagcaagtggggtaacgagaacacgaaaatggtgtatgacaattgtttcagacattctctgaatgccgaaaatcccattcctcaatggtaccttttaatgaatggtgatgaaataataggatgtgcgggacttaccagcaacgattttaactctcgcgcggatttatatccttggctggttgccttattcattgaagaaaagtataggggaaatcattacgccaatcttttaatagaacaagccaagaaggatacactgaaattcggattctcgaaattatatttaagcaccagtcatacttcgtattacgaacgcttgggcttcacatatatcggagattgctggcatccttggggagaaagctcccgtgtatatgagattattttaaaattctgacttgtacattcccgataagtatttgtctgggcaaatgacgatattgccgcaacagaaagtaacagaattaataagattgttctctaatattcattctggttttatgtccctcaaatatacgaaaaaaagggcataaaaaaaggctatctatcccagacagccaatctttttgttaaccttaaatctaatactatgaaaaacacactacaaagatacggactttctgcatatctccaaatttccggagcaaagcggagcatcttataacatggtttaatagaagtagcagactcgttaacatttaacataattcctccggatattaacgaatacccgaaggagtgatctaaaaactattcatatcttaacgaacgagcaggtttgctcattattattttcattgtctgaaaggccaccgtcacgaatgaaatgaacaacatcaacaatacgggcacaataaagaaccaggcttctaaatccgtccggaaagcataatgactcaaccaggcgttcatactgaaccaggctaccggaagagcaatcacaaccgctatcagaatcagcaggaaaaatcctttgaccaactgatagaaaagattccagcgggaagctcccaagactttacgtatacccatctctttcgtacgggtggaacaggaaaacatcaccaatacccaaagtcccagacaggatatgaatatcgctaatccggtgaaagaacctatcatcaccccgaatacttcatcctgacgatactgatggtcgaagaactgatcgaggaaaaaataatcgaaactggaatcagcaaagtaccgattccatatttcctgtacctgcgataccagttcgcggggattgccggaagtcattacgatagaaatatagcgttgtggcaaccagtctatcttatctttatgaatcagcataataggagtataattcttactcaacgcctgctgatgataatctttgaccactccgataatctgcatcggagcatcggtacattctactgttaccaactctcctatcgcctcatcattggaagcaaagcccagattgcgtacggccgtctcattaatcaccagtttatctacatcgtctccgtactcttctgaaaagccccgtccggctatcacttgcaaaccatatgcctctatataatccggatcgcaggccagcatctcataaagccgattctgcttcaaagcgtcattggtacggcgattggaaaggaaagtagccacctcctcgcccggcacagcaccggaagctgcgacactatgcaccagtggcaaccgcattatcgctttcttcatcgcttccagcttcacattcagcccgtctgtacgtccgggaaatttaatgactaatgtctggtcggttttcacccctaatgattggctgcgcataaaattcagctgtgcaaacacgatcaatgttccacaaagcagtatcatagaggccgtatattgaatgataaccaacacctgacgagtccgttctccggacttgctatgcaaaaactttcctttcaacagggtaatcggtttacggttcagcaaagccaatgccggataatatccggaaaggaatatccctgcgataaaaacaagaaccagcagcatccaccaataatccatcagccaaacggagaaagtgaccgtacgtcccaccagttgattaaagtacggaagaatcagctctatcagtcctaccgccaatataaaagcaatcagattcataaccagcgcttcgaacaggaactgatgaatcaactgcttgcggaaagcacccactacccgacgcactccgacttccctggcacgctccatcgaacgggctactgtcagattgatatagtttatccaggcaatagccagaatggcaatggctgcaaagacaagtgcaatcatggcagaacgatttccttttgtctccatttcataacccaattgcggagtgagatgtatatctgccagaggaaccaaatcgactccccatgttttgtttttcaacgcttcctccgtcttgtacttttccgccatgacgggaaactctctttctatttccgcttccctctccggcgaatcgagcagaacatacgtatatgcttcatgcttataccagtattcatgtataaacttgggcagagatgtatacgaaatcaggaagttataatgtatatgggaattggaaggcatttcctccatgactccggtcacttcacacgatatcttataatagggaccggtaaagataagaatctttccgatagggtcttcctctttgaaatatttgcgggcaatgcgctcggtgattacgacttgtcccggcatcgaaaggctggtctttttatcacctttcaaaagctcgaaatcgaaaagacggaaaaagcccggatcggcataagctatctggttttcccgcagtgtcaactcaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcgcggaatgtactttgcacacggtaaatatggggatatttcgtgtgcatcttgtcaaaactgaactcaaaagttacatacgtcagaatcagtaacgccgatgccatgccgatcgccagtccaaacacattaatgaagctgaacttcttccgcttcatcagattccgataggcactattccaataatttcctatcatacagcttcgtttttagaggacgtacttttttctaacggacggttgatgttttcggatacaatctgtccgtccaacaaccggataatccgatgcgcatacgtcgcatccctttgagagtgggtgacaatgataatcgtagtcccctggcggttcagttcgctcaacagctccatcacttccacgccattcaccgaatccagatttccggtcggttcgtcagccagcaacaacttacagtccgtcactaccgcacgggcaatggccacacgttgctgttgtccgcccgacaactgttgaggataatggttggcacgatgtagcagatttactttctccagcactttgttcactttctctttgcgttgggcagtcttaatccccatatagacaagcgggagttccacattttcgtataccgtcagttcgtcaatcaggttgaaactctggaagataaagcccagattattcttccgaagggcagtcagctggttctcgttcattttatccacctgtttcccttcaaagaaataagagccggaagtgggagaatccaacgtgcccagaatattcagcaacgttgacttgccgcatccggaaggtcccattatagcaacaaattctccttgttctacgtgtaaggtgacttcgttcaatgctttcgtctgcacctcttccgtagtgaaaagcatagacagtttttctgttttaatcatggtgattctttttatttattttagtattagtttctcattgtctccgaacaactcataaccggatatgattactttctcacccgaagacaaaccttccgtcacctcataatactgtggattctggcgcccgatcttcacaggacgccgcgtggcaaatttaccactttcatcgacaatatacatccaccgccctccggtaatttgaaagaatccgccacggggaacaaggatcgcttgtgccgggtctcctaactgaaggttgatatgataagtttgtccggcacgtatattctccggccgctccgaaatgaaagccaggtcagtacggaactgcccttctttcacttccggataaggtttggttacttccagtttataggttcctccgtcacgggtaaagtcggcaggaagtccgggaagtacacgctccacataatgctcgtctatctgtgcctgtactttgaggtccggagtaataatctggccgatatgttctcctgcggaaatggactgtccgacctgcgcattcaagtttcctacctgtccgtcaatcggagctttaatcttcaggttttccaagcgctcacggaccaacgtaagactgcgtttcatgttgcgtatgttctcgtccagactgctgatctggctttcacggaaaatattatcctgacggatacgttcgtcaatgaccgccagttgttctttggcagcttcatactcctcctctgcctgacgaaaatcctcgcgggcaatcagttgctcctccaccaaacgtctgtattgttcataacggcgttttttcaatgtaagttctttattcaagcctatgcgttcctgtttcagttgcagacgctcctgctccatactgatgcgggtattgcgcaattcattttcctgataggcaaggtctgcctcactctgcatgattccgatattcagcaacgggttgctgagacgcagaatcacatcgcccgctttcaccatagctccttcttctttcaaacgttcttccacacgaccgccttctatggcatccatatagataatccggctgggcatcacttgcccgatcacacggatataatcattgaactccgcttgcttgacggtagcaatcgtgagacggtctttctcaactgtcatggaggaagccgtatctctaaaaataaaatataaaatgacagcgattcccagcgccacaccaccgatcgtataaaggtgtttgcgatttatgccgggtttgcgttcaacaggtgtatccataaaggtatattcaaaatagggttgttattaaatgattgttccgatggcacagactccgttttacaggaaagtcccctcccgatagtatttctccagtttcctcatcatttccacttgcaggcgtacacgaaccagttctgccttggcggagataaaacggttacgggcttccatcagctgaaagacggaaatgagcccttcctcccatttacgttcagactctttcagtacgagagcttctgcttcaagctgttgcaatgcctgttgatgttcactaaatccggcatgtagggaaagaagtgtttgctctatatcggtatatagctgttgcttttccagttcttcttcattcttcaagcgatacaggtttagtttctgcttccgttgatgagtcagacgttccaatccgctcagcaaaggaaacgaaataccgatgccgacatattttcctatattgtcccgcaactgtctggcagaaaaaactgtattgtaaaaattggaaccaaccgtaaagcgggcatagacagaaggagaaaaagttccgccagccatcgcatactctttacgggcagcctttcgtttcaaatcaatcatacgcatgacgggaagtatttccagtgattgggcataaagtgtttccgtagacggaacagaaagcaagggcaactgattcgcttccacaatagtatcctgaataacgagtgtatcaccgggttggaaattcattagctgttccagatgcaataaggccaaccggcaagtattctcacgagatttataacgatagatatccccttctctgcgggccttgacttcctgcaaatcggaagcggatttcaatcccaactcaacaaaggcttcggtttgtttcagataccgctcactcaaccggctttgttctaaagcaagattcagcagttttctctccagaatcagtttataataagcatccgtcacttgatatgccagttcattctgcctatttttcaatgcccattcgctacgttccttattcatcttccggaagcgtacctgatgaatgcgtgaaaagccttcaaaaagagaaagagtcatatcaagccccacagtcccttcttcaaaagtttcgttggtatatccgttcgtatccggatcgatagaacgcccgaagcgtttccctgtttctgcattaaccgctgcacggggaagaaaagcaccgacagcagccatataatctgcccgtgcctcctttatatctatcacactgttccgcacagaaggattctgcttccatgccagacgaatgcactcatccaaagtcatgccggactgggcctgcacaaaatgcggcaataagaataaggacaaaaagaaaaagtttttcattctttataatatatgcgattgtgtgttacgatgattagaaggcaaataggaagccacaatttttaagtaattgattattaaccaaatgaccaatacgattgcattgcatccgtccaattattacacaccgcaacgtccaacttttggacgttatccattatttcatattcttcgggagcaattttcgggaatttaagtaagccttgcagtaaatatgcccgaaaacgtctaattattggacactcgcttgcagaggaaagcaaaaacgaatatctttacccccaaacttaaagcatggttcaacctgatagctacccccaatcttagatatggaaaacggaactattttaatagtagatgataataaaagcgtgctagcttcactggagttattgctcgagaatgagttcggtacagttcgcaccgccgccaatcccaatcaaatcaccacgttactgactaccacctctatcgacgtcgttatccttgacatgaatttctctgccggcataaacaatggcaatgaagggctgtactggttaaaacaaatccacgaaatccgcccatctttgccggtggttatgctgactgcttacggagacgttgaattggcggtaaaagcactaaaaaacggggctactgattttttactcaaaccttgggataatcagattctgattcggaagataaaggaggcttataaaagtaacaacagcaaagccaaaagcgcttcaaaggcaaccggcaaacagggggataccgagaaaccgagcaaaccggaaatgttgatcggccactctcccgcaatgctccagttgattaaagtggtcacgaaagtagccaaaaccgacgccaacatcctgatcacaggagagaacggaacaggaaaagagatgttagccaaagagatacatcgtttatctccccgaaattcccgtcaaatgcttggcattgatatgggcgctatcagtgaatcactcttcgaaagtgaactgttcggacacgaacgcggagcgtttaccgacgcatacgaaagtcgcccgggaaaattcgaagcggccaacggcagttccctctttatggacgaaatcggaaacctttccattgcactgcaagccaaactattgactgtactacagaaccggaatgtcacccgaatcggaagtaacaaagtgattcccgttgatatccggctgatctctgctaccaataaagatattccggaaatggtaaagcaaggactgtttcgggaagatttgttctaccgtatcaacaccattcatctggaaatccctcctttaagggaacggggagacgatatcctattattcatagatactttcctccgtcgttttacttccaaatatcaacggccggacatacggatgcacgagcaaacgattgagaaactacgctcctatcactggccgggcaatatccgcgaactgcaacacgccatcgaaaaagcggtgatcttatgcgaaggcaacgtgatacgccccaaagatattctggtaaagcaaagctggaaacctcagacggcaagtgtcgtccccaatctggaggaagtagaacggcaagccatcgaaacagcaatcctccaaaacaatggaaatctgacagccgccgccgaacaattaggcatcagccgacaaactctctataataaactgaaacgattcaaaccctgaacaagatgatattcagtcgacatatctattggaccatattgcttcgtatcctgctcatcctcgcaacttcgggaacagggctgtggctcatcatctcccaacgtggcatcatcatcggtatgttactaatcatctgctccttgtttcaaatcggcggaatagtcacttatctcaataacatcaaccggaaactccggcttttctttgatgccatcgaggacagagataatacattcagctaccccgagcaaggaataaacgaagagcaacaacagctgaaccgttcactgaaccggatcaacgccctattggcacaaaccaaaatggactaccagaaacaggaacatttctaccggtctctgctggagaaagtacccaacggaatcatagcctggaacaactccaagaaaataatcttcgtcaacaacacagcgttgaccttactaaacatcgaatcactgactctatattcccaactggaaaatatcctgcagaatgagaagaacagaaaaagactcagcctctcccaaagtcagatgaaactacaagacgaaacaatcaccttgctttccatacaagacattgacgaccggctcaacgaaaacgaaagtgaatcatggagcaaactcagtcatgtcctgactcatgagatcatgaacacgatcgctcccattatctcactgtctcagacactggcttcctatccggaaatcagcgagaaaggaatccgcgggcttcacattattcaggcgcaaagcgaacggctgatggaatttaccgaatctttccggcatctgtcctatcttccgcagcccgaaaagcgtctcttttccctatccgacttattacacaatctggaggaactgcttcaaaccaattttcaagaaaacaatatctcctttacactccggtgctcccccgaaccgatgatgaccgaaggagacgaaaagcaactgtcacaagtgtttctcaatctgttgaaaaacgccatgcaggcattggaggggcatccgcatggagagctttccctgcaagcagaacaagacgaatatatagtcatagacatcaccgacaatggtcccggtattcctcccgaaattatggacaaagtattcatccccttttttacgactaaatcagaaggtacaggcatcggactgagcctgtgcaaagaaattatccgccgccacgaagggcatttggctatcaaagaaagcagagccggaaaaacggtttttcatattgagctcccttaaaaacaacatacgtaaacctcataccggacattcaaactttttccactgttcttttgtttataaagcagaatatctaaatacataatatgagcatcaaagaacaatactggaaatattccctcatcgtcatcatactatttatgggaatcatcatcttccgtcagatcactccttttttgggaggattgctgggagcactcactatttatattttggtacgcacacaaatgacgcacctgacagaaaagtggaaactgaaacgcagtgttgccgcattgctgattacggcagagacggttatggtatttttggttccgcttggactgacaatctggctactggtaaaccaacttcaggacatcaatctggacccgcaaacattcattgccccgatgcagcaggtggcagagtttatcaaagaaaaaacgggttatgatgtgctgggaaaagataccttgtcattcattgtctccatcctaccccgcatcggacaaataataatggaaagcatcagcagccttgccatcaatctgtttgtcatggtattcgtactatactttatgctgataggaggaaaaaagatggaagcttatgtgaatgacattctcccgttcaatgaagcgaatacacaggaagtaattcacgaaatcaatatgattgtacgttccaatgccatcggcatacctctgttagccattattcaaggaggggtcgccatgatagggtatcttatcttcggagcacccaatgtcctggtattgggattcctgacctgcttcgccaccatcattccaatggtaggaactgccttgatatggtttcccgtagctgcctatcttgccgtaaccggagactggttcaacgctatcggactcgccgcatacggtggaatagtcatatctcagtcggataacctgatccgattcatcctgcagaagaaaatggcggatacccatccgctgattacgatattcggagtcgttatcggtttgccgttgttcggatttatgggagtcatcttcggtccgttgctgctttcattattctttctattcgtcgacatgttcaagaaagaatatctggatttacgaaataaccttcctgcgagatgacggagctaccaaaaaaatacgtacttttgcagtcgtaaaaacgacacttatatccaatggaagcatttacattcaatactgtcgaactgattcttttatcggcggcaggtattctttttatcattcagctcatttattatttcggcttgtacaatcggatacatgcccacaataaggctgtacgcaaagaagcagtgcacttcacacaagagatgcctccgctttccgtgattctttgtgcacgcaacgaagctgataacctacgtaaaatcttacctgccattctcgaacaagactatccgcagttcgaagtgattgttatcaacgatgcttctacggatgagacagaggatgtactgggatttatggaagagaaatatcctcacctctaccacagcttcactcccgacagcgcacgctacatcagtcataagaaacttgccctgacattgggcatcaaggccagcaaacacgactggctggtatttacagaaacaaactgtatgcctgcaagcaaagactggctcagactaatggcacgtaacttcacttcacagactcagatagtactgggatacagcggttacgaccggaccaaaggatggctgcacaaacgggtagcctttgacacgttattccagtctctgcgttatttatgctttgcactggcaggaaagccatacatgggcatcggccgcaatatggcttaccggaaagaattattcttccagagaaaaggctattccacttatctgaacctgcaacgcggggaagatgatttattcatcaaccagatagccaccccatccaacacacgtgtagaaacggatatcaatgcaactatgcggatacaaccggtatacagctacaaagaatggaaagaagaaaagataagctatatggcaaccgcacgcttttatcacggtgtacagcgctatttgttaggattcgagactttctcccatctgctgttttacgctgcctgcatcgcgggtcttgtattcggcatcctcaacaaccattggctggctgccggaattgcattactgatctggctgttccgctataccgtacaggcaatcatcattaatcggacagccaaagaaatgggcggagacaggaaatattatttctccctgccggttttcgatatcctccagcccatccagtcgctcaaattcaaactttaccgctccttacgcaggaaaggagactttatgagaagataggcaactgctgattacatgtgccgctgcatataaatcgcatccgaaccatcatgataatagtttggctttactcccacgggaataaagccatttttcatatatagcttgatggcaggcgtattcgactcttttacttcgagcgtaatctttaccgccctacagtcaagagctgtctcaatcgtccgctccatgagcaactgtcccagcttccttcctctgcagtccggatggacggctatcgaatatattcgcagataacgagttcccgcatgaaacaataatgagacataggcgattatccgctcctgttccaccaccacataaaaggtgccctttgaacggcagatcagataaacaaactgttctctcgaaaaactatcttcctgaaaacattcctgctctatctccagaatggcaggaatgtctcccgcttttgcctgacggaggtgtatcgttggttccatcattaataatgtttcatttccagcgcctgctcaaagtgattcaacagacggtaatacatttcgtcaccgataatcgcatcttccagttcatggtcgatactcggattatcgttgatttcaatcacgtaagccttatcatcgaccatcttcaaatccactccatacaagccttttccaatgagattggcagcctttatcgccgtatccagtaccacacgcggcacctgatagataggaatcgtatccaccagtccgcagcggctcctgcccgaatcataatggcagtaaatctgccaatgaccttttgccatataatacttgcaggcatacaaaggtactccgttcagcagaccgacacgccagtcaaactccgtaggcgtaaatgcctgcgccaacaagatagccgacttctcgaaaagaagttcaagacttgttttcagttcttcttcattggacacctttttcatgccaatggaataggaaccgtccggtatcttcaagataaaaggagcaccaacctgctcactgatctgttcgaacgagttctcattggactgaaaaatcaacgtagacttcggtgccggaatcctttctttctcaaaaagttctttcagataaaccttattggtacaccgaatgatagacaacggatcatcaatgacgaccatcccattctgggcggccaactgtgacaaatggaatgtataatgattcagcgatgtcgttgtccggataaacagcgcatcaaattccaacagacgcatggcatcatcctctgtaatcatttcgacgtggatattcatcttcttggccacctcggagagtttatgcaaagcgcctttgttgctgggcggaaatttctctttcggatcgatcagtaccgccaagctatatctcggagcttttgccgacttaggcgcacgccatattttcttattaaagttatccagcgtattggcaaagaagtcctgttcctcatcatccaaccggttcaaaggcaagaactgaatactttcaatctgattcttcggatgagtgttcagagcgactctcaacaaagggcagggatagttctcgaaaatgaagcgggccactctttccagccctttctcacggcatttcccgaaatagatattcagataccagatatcacttttgatcccgttcttctgaatccattgataacacaacgcctgcagacttcggtccatgcggattcctgtccccgtctccagtttgttgatgatgtcaacatcgggaatcacccgttgtcctctcgtctgggcaagcaacgaacagtaatacccttcggagttatagctgtaatcattgctaagattaataactaacttccggtctttttcaaccggcttgttcttcagatagtcggaaacagtcaggatacttttcgtctcacaatacggcttccagtcatccggattatccaacagaattaacacattattcataatggttaaaaattaaacctacaagaggatattaagtaaatcgggcgcaaatatagacatattattcactctacatcacgctacggtctaaattatttttgcagcaaaaaaagaaaagaaaaagagaagattactcgtaccgcatggagcttgcaggattgatcttcgttatcaagtaagaaggtccgatcagcatcagaaccgatgccagcaacgtacctgcattgatcaaaaggaagaaccagacattgaaagaaaccgataccgtatcaacataataattctccggatcgagcttaaatattccgaattgggactggataaaacagaatgccagtccaatcgcattgccccaaagcatccccttgccgatgagaaagacggcaaaccaaaggaaagtcttgcgaatcgtaaaattatcggctcccagcgctttcagtattccgatcatattggtgcgttctatgataataatcagcaaaccggaaatcatggtaaagccggcaactcctatcatcaggaaaaggattacccatacattcagatcaagcagattgagccattcaaatatctggggattcagttgctctatattgcgtacataatacacgcctccaaacttatcacgctggctatccgtatcaacggctatctcgtaagtgatatcttccagtttatcatagtcgcgcacctgcagctccactccgctcacctgctccggttcccagccattcagacggttcaccaaataaaggtcagtcagcagaaacagattatcatactccgagaaattggtctgataaatgcctgcaatcgtcaagcgccgggcacggatattatcctgaatataataggtatatatcttatctcccagcttcagcttcattttggtagccagcgccttggagataagtacctgattactcgaagccgaatcgctgaacgcaggaatctccccttccaccagatactcctgcataaaactcggatcaaactccggtccgacacctttcagtaccattccctgaaaagcatcatccgtttttatcatccccggcttggtagaataacgttgcacatggcttacttggggataaccggaaagagcagtcatcatactgtcccccaccgctatcggatgagtctcataagaattgaccgcatccagattcgctatctgaatgtgcgacccgaacccgatgactttattccttacctcacttttaaaccctatgactaccgccaccgcaataatcataacagccaaccctatggcaataccagccatagcaatgaggaccgcaggacgtgaaacctgttttccaccatcgctctcgcgataaatacgacgggctataaaaagagataacgacaattcttttaagtattaagtaataggtattaagtattagccgtagcttatttagagattaagtattaagtgttatattaagtattaagtcattaccttatgatatattatcaatcttataatatctcatacgccaaccagcgtctacggttaatacttaatacctattacttaatacttatttcctattccgttcttcccggatacacctccaacgccttttgcaggatgaaaagcgcacgggtcaaatcttctttcttcaatacgtaggcgatacgcacttcattgatgccggagcccggagtagtatagaaaccggaagccggtgccataaatacggtctggccttcgtattcaaagtcagaaagacaccatgcacagaacttgtccgagtcgtctacggggagtttggctacggtatagaaagcccccatcggaatcggagaataaacgcccggaatacggttcaatccatcaattaagcatttacgccgttctacgtattcatcatacgtctcacgcgaatattcctccggagcatccaaagaagcctcggcggcaatctgtccgatcaaaggaggactcagacgagcctgacagaatttcataacagcgtcacgtatctctttgttcttggtaatcaatgcaccgatacggattccgcactccgaataacgcttggaaactgaatcgatcagcactacattattctcgataccttccagatgacaggcagagatataaggagagccggtataaataaattcacgatatacttcgtcagagaagaggaagaggtcgtacttcttcaccaggtcacggatctgattcatttcccgacgtgtatacagataaccggtcgggttgttcggattacaaatcaggatagccttggtacgttcattgatcagttcttcgaatttctctactttcggcagggagaaaccttcttcaatggtcgttgcaatcgtacggatctttgctccggcagagatggcaaatgccatgtagttggcgtatgcaggttccggaacaatgatttcatctcccggattcaggcaggaaaggaaggaaaaaagtaccgcttccgacccccccgatgtaatgattatatcgtcagccgtcaggttgatgttgaactttgcataatatcccacaagtttctcgcgatagcttctgtttccggcactggggctatattccagcactttacggtcgatgttgcgtatcgcgtcaatcgcggcctgaggagtgggcaggtcaggctgtccgatattcaggtgaaacacatggactccccgttgcttggcagcgtctgccaaaggagccagttttctgataggagatgcaggcatctcgtttccgcgaatggatatggttggcataattttaactacaaattactaattactatttacttttttaatttggaactgcaaatgtacgcaataatttgaatacagagacataaaaactttaaaatccttatcaagggtaaaaacgtagtggaaaaatgaaaagaaagctatacatttgtaatacggaaaacttaaaacaatatcataatgaccatacaccttatctcatttgcttcaatacttcacaaacaagcctcgctgcgcaattcgcacgaagcaattctgagtgaacttgaaaaatattacactgtcaaactcatcgattatcaagatatggataagttgggcagtgatgatttcaaaatcatttttatcgctaccggaggtgtggaaagactggtcatccagcacttcgaacgtcttccccgccccgccattttattggccgatggcatgcagaactcacttgctgcggcattggaaatatctacatggctccgtggaaggggaatgaagagtgaaattcttcatggagaattaccgtctattattcaacgtgtacatatactatataataatttccgcgcgcagcgttctttgttcggcaagcgtatcggagtcatcggtactccttcttcgtggctggttgccagcaatgtggattatcttctggcaaaacgccgttggggaatcgaatatatagatattccgctggaaagggtttatgaacattttaaacaaatcacagatgatcaggtaggcgcgtcctgcgccgccgttgcttcgcaggcgcttgcctgccgcgagggaactcccgaggatttaatcaaagcgatgcgattatacagggccatcaagagaatttgcgaagaagagaagctggaagcgctgacattaagctgcttcaaactgatcgatcaaattgatacgaccggctgtctggcattgtcattgctgaatgatgacggtatcatggcaggctgtgagggagatctccagtctatcttcactcttctggcagttaaggcgctgacaggaaaagaaggattcatggcaaatccatccaccatcaatacgcgaaccaatgaattaatactggcacattgcactataggactcaaacagacggaaagatatattatccgcaatcattttgagacagagaaaggtatcgccattcaaggactgctgccgacaggtgacgtgactatcgtaaaatgcggaggcgaatgtctggatgagtattacctgtctaccggaactctaaccgagaatacgaattatatcaatatgtgccgcacgcaggtgcgtatccgcatgaatactccggcggattatttcctgaaaaacccgctaggcaatcatcatattatgattcatgggaattatgaagaagctttgaatgagttcctgttatcgaatgcctgcaaaaggacggaataggggatcgaaacagaggctctgttatagataaatgcaggctctgtcagcagttgacggagcctgcatttattataaacagaagctctgttttattgtaacagaggcatatctttccactgtccgccgtgccactccactactgtgtcaaagccgactttcttcaaggctgccaatgcttcggcacgactgttattaatccgttccggataatgggcatcactattcacctgtacccgaatacccaattctttcaataaagggaaatagcgttcgttcggatagaaagttcccaaatcatgataagacttagtattaatttcaacgatatatccatgacgggctatttctgcaaaataatcgcgaaccaacgcatcataccacggttcgtccaataatcccggacgatagcaagaggcattatagtgcatcttatctgcatgaccaaggatatcaaaacctcccagctcgaccatacggagcagattcttataataaaggtggacaacgtaatcgagatcaccttcaaaatgcgcatctatcaattgacggaatatatcggcaggggtatcgatatccacgactttgccctgcggagaatagagcatgtgcacagaaccaatccgataatcgagcggcaattcctgaaaacgagggatagcgggatggctctcttcattcagatagtctatttcgagtccgatggcaagctctattttatcggcatatttctccttcagacgagcaaattcggaaaggtaatcatccatccggtcccactccatcgtccatgctgtagaaaatggcagaggagcgtgagaagaaatgccataagaagaaaagccttcactaatggcaaaacggataaaatcttccatattagctcgtccgtcacaatataagcagtgactatggtaattggtcaggtttgtcatatcggtctatgttatttcggttattatcaggttgtttcagttattacagtttctttccgttcagattcatgtcagccttctatctcgctcagttccagccagcgcatggtcttttcgtcaatcagatcattcacttcgggcagacgtttcgacttttcagtcagttcgtctacagaaagcattccgctgcaaagcagttcttcaatctgtgccttctccgcttccagttccgctatttctttttccagttgttcgaactcacgcttttccttgaagctcattttccgcttatcgttcagacggacacgggcggtcttctcttcctgcggcttttccgcttccttttctttctgtgccttggcttctttccagtcacggtaatcgctatagtttccggggaagtcacggatatctccctgtccgttgaataccatcagatggtctactaccttatccataaagtagcggtcgtgggaaacgactatgacacagcccttgaagttctgcagatactcttcgagcacattcagagtgatgatgtccaggtcgttggtaggctcatcgagcacgaggaagttgggattgcgcatcagcaccgtgcacaggtaaaggcggcggcgctctcccccactcagtttatagacatagctatgctgcgtttcgggagtaaacaggaaatgctgcaggaattgcgaagccgtcagtctctttccattccccagttcgatcacttcggctatatcctgcacgacatcaatcaccttcatttgttcgtcgaactggagaccgtcctgcgagtaatagccgaaacggacagtttcgcccacatccaccgttccgctgtcgggtttgacctgtcccatcaatattttgataaaagtagatttacccgttccgttgtttcctacaattcccatcttctcgtaacgggcaaagatataggaaaaatcatccagaatcttcaggtctccgtagctcttgaacagatgatcggcttcgaatatcttgcttccgatataagaggcctttacttccagttttacgttgtcattgttgaaacgttgcttggcaaccttctccagttcatagaaggcatcttcacggtatcgggctttgtgtccgcgtgcctgcggcatccggcgcatccagtcgagttccgtacgatagagattgttggcacgttctatttccacgcttttagcctcgatgcgttcctgacgtttctccagataatagctgtagttacctttatattgataaatctgctgattgtcaatttcgataatctccgagcagacacggtcgaggaaataacggtcgtgcgtcaccatcagcaggctcaggttggtgcgacgcaggtagtcttccaaccattcggtcatgtccaggtccagatggttggtaggctcatcgaggatcagcaaatccggttcggtgatcaaggcgttggctaaggcaacacgtttcagctgtccgccggaaagctgcttcacccgctggtcaaagttacggattttcagttgggacagaatttgcttggctttctgctcatattcccatgctttctcctggtccatgcgtgccaagaggtcttccagtcccggatgcccttcggtttccatacatcgttcgtactctttaatcagttcgacggtgctgttgccgtgatggaaacaggcttcgagaacggtcagttcttcgggatactgcgggtcttgttccagataatccacacgaaggtcacggcggaagacgatgtttccgctgtcatacccttcttttccggcgatgatattcagtaaggttgtttttccgctgccgttcttggcgattaatccgacgcgttgcccctcggcaatgccaaaagatatattttcaaaaagaaccaagtcgccgaaggacttggtcaggttgtctacttgtaaataaggtactgccacgtaatttagtgattagctggttcgtgatttagtgatgatcgattgccgattgatatgcttcggcaatgttgcagggttggccggccttaactttgctccatgcgattttcatcgggtcgatggtccggccttggtattcgagtacggggacttcccgattgccgtcaatcaaggttttccactccatgccttccacttcgttagtcagaatcgcgcataccgttataccgatggcgagccattcatctttcttcttggggctgatcttaccgctgtctatcacttgctgaatcttctccaagtcctcttccactccctgaaagtcttttttgagttcctgtttgacggtagatactacccactcgtagccttcattgatctgatagatttccgataggcggacgggaatcagttctgcgggatatttctcgccttccttgcgggcttccagtgtagcgataacctcttccgcttccttggcgcttccgcctttgggtacggtgaaagaacattcaaaagcgatattgccggttcctgttatccacaggtgagaagtataataagtgccctcttcctgaaacatttctttactgtaggcacagtcccatgtaccgattttcaccaatgaagccgaatcgttttctttcagttcctgacggatggcatctttaccgtatgaggcgttgcctttaaaagctgatatacgaaagttgcccgtccatacatcggggttatagaaaagaaaagagccttcgccatcttcaaactcgttccagtccgacggataattcatcgaaaaccatgctccgggggagataaatttcttgccttgcatcctttttcattaaatgattacttgggcaaaaatacgaattaaaaatgaatttcactttcctatcggctgtattttcctccgtacttctttggaaatctccagaaacatatagttcagctttccggaatggatgcctgcttcattgtctttgtactttttgttggcgtactgtttggatttctcgaaagtgagcagtgacatttcgttctgcgatttgccgaccatggtagagtccagttgttcatccgggaagaagtcgtcgaggtctacatcaccgatcatcgtcgtttcgaggaagttcatgtccttatgagagttgtcggtgtagtatcctacgaacatatgccccggtgtacgtaccagtatcggttcgatattaatagcccgaaggagcgaagcgaacagtacgctgccgtccacacagttgatctgcgacgattccagcgcatcgtcaaaggtgcggacgcgttgcgagaaaacgacattgctcgaaaggctcgtattggatacggaactgtagcggaacttacgtttctgtaagatgttccaaagtgcgtacacctgcttgtctaccgcacctttggccgtgctctggtagcccaggaaacgattcacgatgcgggtattcagcgcttcacgaagcagctggtcgatcatcggattctcttcgttgacgtatgcggcaaaaaagatactggtatcgtaaaacttcgtcccgttcgccacataacccaacaggcattcattgacgctacgcaccgaaaacgtacgtacccgttgtcccaagtctttcccgttcatctccacttttacggctacgctcaccggttccgcctgtgcgttattcttcagtgcctcgtaattccagatgatatcgggataaatagtatattccgtcctcggcttgttcagcacaaattccgacacggaacgggaaaagaaaggggtctcggcaacctctatccgcactcggctgtaagcagtcctcgacttcacccgaatggcgatgcacgatttcggatttccgagacaggtagaatccgaaggagtaatcacctgcgcgtccgtagtggctaccgacaggatggccgacggaaagatatttcctcccagatcgtctacgatctcaaagccggaattaaaagaagtatatttaaagacggagattcccccgatgagaagaagcagtacaatcacccctcctaccacttcgcgtctatatcgtttcaagtctatttttatcatgatctgcaaactgtgtatttattatcctatcgctacacaaagataacaaataacagacggtttttcctcgcatatcccataaaaactttcaaatatcatcccgatgcccgcattcagcggaatgtaatacgattgtaatatttgtttcatccgcccgtaacaaagtcttctcatctttgtcccgaaataaaaaaaagcttaactttgtcatatcacattaatacatatatcatatgaacgattaccgtattttagttgtcgacgatgaagaagacctctgtgagattctgaaattcaatcttgaaaacgaaggttatgaagtggataccgccaactccgccgaagaggctctgaagatggatatcagcagttaccacctgattcttctggacgtgatgatgggggaaatctccggtttcaagatggcaaacatgctgaagaaagacaagaaaacagccagagtgcccatcatcttcatcacagccaaagataccgaaaacgataccgtaacaggcttcaatctgggagcggacgattatatctccaagcctttctccctgcgcgaagtgatcgcccgtgtgaaagccgtactgaggcgtaccgccacgatggagacggaaaaggcgcccgaacgcctgacttaccagtcactcgtgatcgacatcaccaagaagaaggtaagcatagacgacgaagaagtgcagctgacgaagaaagaatttgagatactgcttctgctggtgcagaacaaaggacgcgtcttctcccgtgaagacattctggcacgcatctggagcgacgaagtatacgtactcgatcgtaccattgatgtgaatatcacccgtttacggaagaaaattggcgaatatggcaagtgcatcgttacccgcctgggatacggatactgctttgaagccgaataatcaagaagtatgaatctacctgtcaagcaaaaacatttcctctctttcagccggaagttattcctttcggtgatctcgctgtttctggtatttgccttttgtttcatcgcctaccagtatcaacgcgaaagagaatataaagtcgagttactcaacacgcagctccagaactacaacagccgcttgtacgaacggctgaacagtaatcccgccatcgaagaaacgactgaaaagtatatccgtgaccacgcgttggaggacttgcgcgtcacactgatcgacttgcagggaaatgtgatctatgacagttatcagactaccgaccagcaactggagaaccatctcaaccgccccgaagtgcagaaagccttgaaagacggaaccggttttgacgtacgccgcacctcggagaccaccgggctaccgtatttctattcggcaacccgctacggagattatatcatccgctcggcactgccatataatgtaagcctcatcaataatctgcaggcagacccgcattacttatggtttacggtcattgtgtcgctgttgctcatggtgatcttctacaaattcaccaacaaactgggaacctctatcagccagctccgcgagtttgccatgcgtgcagaccgtaacgaaccgatagagatggcgatgcagtccgcttttccgcataatgagctgggagagatttcgcagcacatcatccagatatacaagcgtctgcacgaaacgaaagaggcactctacatcgaacgcgagaaactgattacccatcttcagatttcgcatgaagggctgggcatattcaccaaagacaaaaaagagattctggtcaacaacctctttactcaatacagtaacctgatttcggactctaacctggaaacgacagaggaagtattcgccatcagcgaactgaaagacatcattcatttcatcaacaagaaccagcagcaacgctcgcggggaaaagacgaaaagcgtatgtccgtcacaatcaacaaaaacggacgcacctttatcgtggaatgtatcatctttcaggatgccagcttcgagatttcgatcaatgacgtcacgcaggaagaagagcaggtacgtctgaagcgccaattaacccagaacattgcccatgaactgaaaactcccgtaagcagtatccaaggttatctggaaacgattgtcaataacgagaatatctcacgtgacaagataaatacgttcctcgaacggtgctacgcacaaagcaatcgcctcagccggctgctacgcgacatatccgtactgacccgcatggacgaagccgccaacatgatagacatggagcgggtagacatcagcgtactggtagggaacatcatcaatgaagtttctctggaactggaagaaaagcacattagcatcgtggattcactaaagaagggtatccagatcaaaggcaattactctctgctctactccatcttccgtaacctgatggacaatgccatcgcatacgccggaaccaatattcagataaacatcaactgtttccgtgaagatgagaattactattatttcagcttcgcagatacgggcatcggtgtctctccggaacatctaaaccgccttttcgaacgtttctatcgggtggacaaagggcgttcacgcaaactcggcggaaccggtttagggcttgccatcgtaaagaatgccgtcatcatccacggaggaaacatttctgccaagaataatcaaggcggcggactggaatttgtcttcacgctggcgaaagagaaataaacagcttggtttttctttattcacagtgcagtcaaacaatcagccaatctcccagattccgtttcccggcatcaaaggacacaccgactttcaccagtcgtctgccatccacagtgtagggcaaaaggtaacctttttcatcaatctgcttcagagcttcttcggcggtgccggtgagtttaaattcgaacacatagatgtagtccgcagtctttactactgcgtcggcacgaccgatagcggtacggacttccgcttgcgtgaattgccccatgagtttgaagacgagatagaatacaacttgataatgacgttccgttttctcgttcagttcgtaaggaaaatcggcgaagaaacaggacagacgagtgaggaaagcttccgtttcgcccgtttccagttcatgcacaaatttcccgatataaaaggtggtatcggtggatgcgacaggagtatagaaaggggcgacaaaattgaggaaaccatatttcacctcttcgttaggaaaccctagtgtatatgtacgaaagcgttggtcgaacgactttatagtcaggtatccgctttgataaatcatcggaacgggattggagatattcgccctgtcgtcactcaaggaggcggaagagacttcaataccgtccaattcgcgaaggtcgaaatttgtcttctttaggatctctaccaaaaaagtaggcgttccgctggcaaaccaatagtcaccgaaacgcgacttggcaagggcattgagcacactgaaaggattgaacatgggagtaaatcctttctcaggagtgaagcggtaaccgtcatactggcgggtgagttgctctacggcttcgccataattggtttcagtctggagagccagttcttgcaattcaggcacaaaaacggtttcgatttccgcacgtgtcatgccgcaaagggtgttgtactcaaggtcaaagctgatatcattcaactggttaagcgtgctgaaaatgcccatctgcgcaaacttcgttactccggtgataaagacaaactgaagataagggtcagcatctttgagtacagtatagaaagcggtcagcgttttacggaagtcttcttgcaaatcaggtttatcgaatgtctgaagcatgggtttgtcatattcgtctacgagtacgaccacacggcgtccggtctgttcgtatgcacgtcggataatggtaatgaagcgtccggagtaggtcattgtgcctttatctactccatacatctcttcccaactttccagttgcagttcaagcattctttccaatcgttccctactgtcatatttctcagcattcaagcttaggtgcaacaccgggtattcgaaccagttctgctccaatttctcgatagcgagtccttcgaaaagttctttcttccccttgaaataagcttcaagcgtggaaagcaacaggctcttcccgaaacgccggggacgactgaggaaataaggcttccctttcgttacgagacgatagaccagttctgttttatcgacataaagatatccttccgagcgaagaaattcgaaactttgtatccctatcgggagcttacggagcgttttaacaggtgcgttcatatcagcttttattaaaaaataaccaatgctacgggcaaagataacaaattcgatgcagattccacccgaagggaagagattatttagccctattcacacaaagtcggctgtatcgataaaaaatacgaagccgcatatccagttttcaaaacttaccggaatatcggtatgttttttcacatagttttcatacctttgctttcgaaagtaagtttaaaccaaccaattgtcatgaaaacaaacataagccttatactcattctgtgccttcttcttggcgcctgtaaaaacgggaatgcttcaagtcaaaacaaaagcgaaacatcgcaagataccattaaggctattaagatgcccgccatcccgcaaatgatgacagcaccggaacaacgggccgactttctggccaagcattattgggacaatgtaaactttgccgacaccaactatatccaccatccggaagtaacggagcaagcgtgggcagattattgcgacttgctgaaccacgtaccgcttgaaacagcccaacaagccatgcgcaatgtaatcgaccggaccaatgtggacaagaaggtgtttacatatatcaccgacctggcggacaagtatctgtatgatcccaactcccccatgcgcaacgaagaattttatataccggtattggaagcaatgatagcctctcctgtattgaacgaaacagagaagatacgtccccaggcccgtcttaagctggctcagaaaaatcgtatcggaaccaaagcgctcaacttcacttataccctggcctccggagcacaaggttcattatatcagttgaaagcggaatatcttctgttatttatcaataaccccggctgtcaggcatgcacagaaaccatagaaggtctgaaaaacgctcccatcatcaaccagcttttacaggaaaagaagttggtacttctctccatctaccccgatgaggaactggacgagtggaaaaagcatctgagcgaatttcccaatgaatggattaacggatatgacaagaagttcactatcaaagaagaacaggtctatgacttaaaggctatcccgactctatatctgttggataaagacaagactgtattgcttaaagatgccactgcaccagccattgaagcatatctaatgcagcatcaatagttaacatgtagttccaatatcagttccaaccgttgaaacaaaatgtttctgccgctcggaactaaagtttcatcggcttgaaaccaaagtttcttcagtttgaaactaaagtttcctctgcttgaaactagagtttcatccgcttgaaaccgttggtttcaacgctttggaactttctaaagcaactatcaattagagtaacttgactgcatgaccggagtaacccaatcgtatcagttattccaattcacccgttctttcaagaagcattaactcatttattggctactaatagatgagttatcagcctttaacacctgatttctcaattattaatagttgatatgtcaatctttaatagttgacgtatcagacgttaacatcctacaaatcaacctacaacactacaaaacgtcacgtcattcgatgcaccggagtgagagcaaccatttgctctcatacctgccaccacacttgctaccacgcttgaaacagcgatgaataaagggatacgcaggaattgttagagcatgagagcaaaactgctgttattttctttttggtagaaacaaataaactatatatctttgtccccgcattggtttgcgactctcatcacgagggaagcgattaaaagggaatcaggtgtaaatcctgaacagtcccgctgctgtaagttccatagatatgttgcgagcaatctactcaaagccactggaaagaaaattccgggaaggcgcccgcaacaggaataagtcagaagacctgccatgtaaaatccgtttcactgctttcgaggaaaaagcgttgaatctaatgacccggacatccgtctatcatttcattcatcactctgattcagagaaagtatgtacaaactaatagactctgccaagtttattatgtgtgtccggtcgaagcgatttcgcccggacactttgatggacatattttatttacttaatatacaaaacatgaattgtaaaaagctattcaaaacgttattatttataataacaacgcttgttattgtgtcttgctcgaaagacgattgtgacctggaccacattgacaaactacaaggattgccagctctgaaagccggcactttccccgaagaggatttgacactcaatgtcggagaacaatatgtatatgcccctaaggcaagtagtccgctggatatatactatcaatggtatcagaatggagaagatatgtcgaccgccccttcattcacattcaacgccgaacatcccggccgttccaaagttattttagaactcagcaatgacttgggaaaagtgacattagaaaataaagtgatggttccgggagcggattactccaaaggatgtctgattatcaatgagggatggttcggacacggatccggaagtatttcattctataattatgagaagaacagcattgaacactggtgctataagaatcagaatttcggagatgtgctgggagttacctcacaatcggctactttgtggaatgggaagttgtatgtctgttcaaaagaagataatcagttagtggtgatggaccctaaaactctgtatgctgaaaacagctgtggcaaactagctaattatcaagcttatgagtttatcggtttgaatgacgattatggaataattactcatggaggatatttcagccgtatcaatttaaaaacgtttgaaacaattacactggtatcggtaggaaatacgtataccggaacaggtagcggaatcgcttataacggaaaactcatattaaatgtgaactcctccgggtggggaagtcctaaagtgtataccatagacattgcagaattatgttcccccgatctcaagcctacagacaaagtcgcattccaggaattagatattgcaacctatggtggtactcgctttgtacaatgtaaagatggaaatatctatactgtagaaacgaccaaagacggtaaaaacaatctggtaagaatcaatgctgatttttctctgaaaaaggttgcaatgcgtgacgattattctccctcctcgttcggtgcttacagagaagccagtttctgcggcactcctgaaggaatattctactacatcgcaggaggaaagatatacaaagccacttttgacaatcccgcccctgaggagacactgaccgaatacaccaaagaaggttacggattctatggcgcaggcatccgcgtcaatccaaagaccaacgaattactggccatgtacctgaccggagactatcagaaaaatcttctggtaagattcaacgccgccacaggagaaaagatatcagaaatagcatacgatggctattatttcccggctacattcatttttaactaataacaagactctgaaacaagatgaataaactatataccactttattaatagcctgccttgcagcaggttttaccgcctgtaacgacgacgattgcgaagatttgcacctcggcaatctggcacattatccgaacgtactgaaaggaactttcccgacagaaagccaagtgttggaattaggagaaacgttggagattactccggaactgcttaatccggaaggagccacctattcatggctggtcaatggaaaagagtattctaccgaaccgacctttagttacaaaatagacaatccatgtcgcgcggacctgtcatgtatcatcaagaataaatacggaaaagtagaaatgagcacaagtttcagctctaaccacaacttttccaaaggattcttctacgtagcagacggaacattcaatttctatgataccgaaaagaaaactgcttatcaagattgttatgcttctttaaatgcaggaaaaactttgggaattggtaactacgactctgcaaatatcattcacagcaacggaaagttctatctgcttgtgggcaccagcacatcgaaccgagatcatttctacattgtcgacgccaagactctttattacgaaaactccgctgtagtaggcgcaaacctaagcggtctgaccattctgaacgaacaatatggattagtgacaggagatggcatacgtcgtattgacctaaaatcacttaacaatgtcaggatcaagaatgagcgtctgctttgtttctataatagcataatctacaatggcaaagtgctgagcaatgacacttataaagatgagtccaaagtgaagtattacgatgtaaacgaactaatcgcagctaaagaaggagaagctcctgccgttacagagctagatatcattcaaaaacagaaaatcaattttgtactggctaaagacggtaatgtttatactcttgaatcggctgataacggatgtaatatcgtaaaaataaagaatgactttactttagaaaaagtctttgcaaacttccagccggccaagggaccgtatcattcaagtccgaccataggcatggtagcatccgaaacagagaatattatttatctggtatcgaccgacggagctatatataaatatatattaggcgattcagactctctcaaagcacctttcattgccgcagaatcaggagtttcaattactgctccattgcagctgaaccaacaaagcggagaactctatgtaacttataccgaagaacggaaagacgaatctaaaattgtcgtttacagcaaagacggaaaagttctccacacagtagactgtggtgagagcgttccttcacaaatattattcaataactaaactaacatagaaaaatgaaaagatattggtatctgatggctatagcagccactcttttggcttcctgcaacaaagatgaggaagaaacggaaattcaaggattcaaagtgctggaatatcgtccggcaccagggcagtttatcaatgaaggcttcgactgccagacaatggaagaagcaaacgcttatgcagaagagcgcttcaacaagaaactctacgtctcactgggatctttcggcggatacatcaccgttaaaatgccgaaagaaataaagaaccgcaaaggatacgacttcggtattatcggcaatcccttctccggaagttccgaaccgggcatcgtatgggtatccgaagacgctaatggcaacggaaaagcagacgacgtatggtacgagctgaaaggaagtgacgaaccggaacgcgactattccgtcacttaccacagaccggatgcagccggagatatcccctgggaagacaacaaaggagaaagcggaatcatcaagtatctccctcaatatcacgatcagatgtattatccgaactggattaaagaggactcctatacattgaaaggaagtatgctcgaagcacggacagagcaagaaggcggaatatggaaaaacaaggatttcggaaaaggatatgccgacaactggggaagcgacatggcaaaggatgacaacggcaactaccggtataatcagtttgacctggatgacgccgttgaccagaatggcaatcctgtaacgctggaacgtattcattttgtgaaagtacagagtgccattttgaagaatgtcgagtcgataggtgaagtgtcaaccgaggtggttggattcaaagctttttaaaaagctgttcaaagtcatggatttaccttcgctcctctcttgcaaaagacaaataaactatctatctttgtcgcgcattggtttgcaactctcatgcacgagggaagcaattaaaagggaatcaggtgaaagtcctgaacagtcccgctgctgtaagttcattttttggttgcgagcaatcgactttatagccactggaaagcaaattccgggaaggcgttcgcaacaggaacaagtcagaagacctaccatgcaaactcgtttcactgctttcgaggaaaaagcgatgagtctaatgaaccggacaatccgtccatcatttcattcaccattctgattcagagaaagtgtgtactaattaataaactctgccaagtttattatgatgtccggtcgaagtgagttcgcccggacatctttttacattatgaacagactgaaagaaaacaatgagaaggaatacttttattaaaaagatgagcgtactactctgctgtcaggctttgtccttatccctttttgcccaacaacaaaaagtggatacagcacatatctactccatccccgaaatcatggtatccgacccttatcagacgcgtgaagtccgttcagcctctcctctgcaggttttcaataaggaagaattaaagaatctgcaggcactgcaggtatcggatgcggtaaaacatttcgcaggagttaccgtgaaggactatggaggtatcggaggattaaaaaccgtctccatccgaagtctcggggcacaacacaccgctgtttcctacgacggcatcaccgtcagcgactgccagaccggacaagtagacataggacgtttctccttaaacaacgtagaccgcctttcgctcaacaacggacaaagcgacaacatcttccagcctgcccgtttttttgcttctgccggtatactgaacatacagacactgactccgcatttcaaagaagacaagccgactaatatagccgccgaatttaagaccggttcatggggattagtaaacccttccctttttctggaacaacaactcaacaaaaaatggagcatgaccgccaacggcgaatggatgtcttcggacgggcattatccatttaccctgcgttacgggaatgatgccgatgttcaggtcagtaaagagaagcgccggaatacggatgtagaaaaccttcgggctgagataagcgctttcgccaatctctccgacaaagagcaatggagactgaaagcctattattaccagtcctcacgggggctgcccaatgccactaccttatattatgacttctcccgacaaaatctgcgggataagaacacctttatccaaagccagtacaagaaagagtttagcagaaaatgggtattccagacctctgccaagtggaactggagttatcagaactatcaggacccggatgctcttacctccgtcggaggaactgacaacagctattaccagcaagaatattacctgtccgcttccgctctataccggatatggaacaacctttctttctccttgtccaccgacggaagcatcaatacgatgaatgccaatttgcagaacttcgtctcccccacccgctattcatggctgacagcctttgccgggaaatacgtcaatgaatgggtgacgctgtccgcttctgctctggcaactgtcatcaacgagaaagctaaaaacggaggtaatgccggcaaccaccggaagctgtctcccaatgtcagcatctcgctaaagccgtttcataatgaagaactgcggttccgtttcttctacaaagatatcttccgtctgcccagcttcaatgatttatattacgacaaggccggaaacatcaatctgaagccggaaagtgctactcaatataatataggtattacttatagtaaagccatcaacaactttataccttatctttcggccaccgtagacgcctaccataataaagtgaccgacaagattgtagccactcctaccaagaacttattcatctggagtatggtcaatctgggcaaagtggatatcaaggggatagatgcaactgccagcctcagcctccagcctctggataaactacggatcaacctttccggaaactatacttaccaacgggcactggacgttaccaactccaatcccaactcaccggaaggtaaagtgtacaagcatcagatagcctataccccgcgcgtctccgcttccggacaagccggaatagaaactccatggctcaatctttcctattcattccttttctccggaaaacggtatatgttaggacaaaacatcagcgacaaccgcctggacagctacagtgatcacagcatctctgcctacagagatttcaaaatacagaaagttacagcatcactcaacctggaagtgctgaatctgatgaacaggaattatgagatcgttaagaatttccccatgccgggaagatcggtaagagtgacgataggagtcaggtattaggtaataggtattaagtaataagtattaggtatgcagaaaggtcttttatataatatgttgctacggctggggaagtatttttttcttttcccactcttctttatcgcttgcgatgatctggaagataagccaagtattgtacccgaaagcaatggggatgtattcgaaaccggaacagcggagatgtacatattaagcgaaggactgttcaatcagaataatagttcgctcgctcgttattctttcaatcggcaaagatgtacgaacaactactttagtgcaaacaatcagcggggactgggagatacagccaatgacatagcgatctatggaaataagatttatgtagtagtcaatgtgtcgagcaccgtagaggtgattgacttccctacgggcaaatccatccggcagatcagtatgttgcgcgacaatggcagttcacgtcagccccgcgcgatagcgtttgataaggataaggcatatatatgttcctatgacggcacagtcgcaaggattgacaccacttctctggagatcgaagagattgtcacagtcggaagaaatgcggaagatatctgcgtacaaaacgggaaattgtatgtatccaattccggcggactggattattcgggaccgggcgtagacactacagtatcagtgattgacataacgactttcaaggagaccaagaaaatagaagtcggaccgaatccgggaaaaatacttccggggctggaagaagccgtgtatgtagtcacacggggaactgacattgaagccggagactatcatctggtcaaaatcgacagccggacggatgcggtcgccattacgtatgatgaaaaagtactgagctttgccatcgacggccccatcgcttatctatatacttacgactatcagactaaagattccgccatcaaagtatttgacctgaatgcaggaaccgtcatacgggataactttatcacagacggaacggctattcaaacgcctttcagcattcaactgaatccattcagcgggaatatatatatcacggaagcttacaattatacagtcaaaggagatgtcctttgcttcaatcaacaagggcagcttcaatatcggctgaatgatatcggcttaaatcctaatacagtagtatttagcgacaaggcttcacagaacgaggcaggcgatacaccggaagatccgaatgcgccttccgcctttgccaacaaagtattcgaatacatccctgcccccggacagttcattaatacaacaacctccgcctacgaagacggcttctctgccggacaggttttggaacatgcaacggagaaattaaagaagaagtctgttatttctttaggtggattcggaggaacgattacagtcggattccatcagtcaatccgtaatagtaaaggcgaatatgacttcagaattttaggcaatgcctcatacaatcagaataccggtacgggagctttgggaggaagtgccgaaccgggcattgtcttagtctcaaaagatgaaaatggcaatggattgccggacgatgaatggtatgaactggcaggaagcgaatatgggaaagatacggaaacccgtaattacgaaataacctattatcgtcctcaacctgccaatggtgatgtccgctggaccgacaatcaaggaggagaagggttcgtctatcgcaacagttaccatcaacaggattcctactatcccaattggatagaagaagatgaaattacttttcgcggaacacgcttgaaagacaatgcaataaatgaaggaggtacttgggtagggtactgttatccttggggatatgcggataatcatcccaacagatcggagttcagccaattcaaaatagactgggctgttgatcaaaacgggaatcacgtagaattagacaaaattgattttgtgaaaatatatacagctgtcaatcaaaacgtaggttggatgggagaaatttccacggaagtaatgacagtagaggatttacatttcgagaactaatcaataaaacaattaataatttaaatgaaagcaaaaatgaaaaagttatctttattcttactggtatcagtattcgctttttgtggatgtagtgatgatgatgagaaaatggaagtagttatcagtttcgaaaaccaattaactgaagcagagagtgaatttaaaacagatttaggagagaaaggagaagtttatttcaaatatgaaatcagcgatccgcaaaagatgatacagctatctcattattatggagactggggatttggtggaggtttcacctacaccaacaagactgatgtaaagactcccggctatagcaacctcagtgctatcacaggaaaaggtaaaaatgggaaagtatatctgacatcaaataccaatagtttcacccctgctcaaatcacgaatcttaatactagcaaatacaacttcaaaggtgcatgggtaacaaatacgacttatgattacttagccatcaaggatggtaatgatggagcaggtgattactcaataatcaaaggcccattcagcaataaagacaatgactggttaaaactaacagcaacaggatataaagctgatggtagtaaaatcggcagtatcgatttctatctggcagatttccgaaataacaagcaagaaatagttaatacatggcaatggtttgattggagcggtattaaagaagcagattatatcacattcgaaatgagttctactgataacaatgacaatggtcaaatgaatactccttcttatttctgtcttgacggtatcaccctcatcgaaaaataaatagcaccgttcacctgaataaaattgaccatatatttgtgcttaatcaacctgtcaattgtaacagattgaccatataatcttatccaattgaccgtatgattacaaataaatgaccacataattattatcaagtaactaaagagccagatttcatttcctgagatctgactctttttatattaatacaataaggatattcatacatatacaagcgtcacttttcattcttattaaaatttattgtcctatctccgtctttacaaaaagtcatcaaaaacttgtctatatcatctatattcagtattttagtcggataaaaatctaaaatcgaagacaatggaattaccttttgctgaatcatggaaaatcaagatggtagaacccatcagaaaaagtacccgcgaagaacgcgagcaatggattaaagaagcacattataacgtctttcaactcaaatcagagcaagtttatattgatcttatcaccgactccggaacgggagccatgagcgaccgccaatgggcaggcatgatgctgggtgatgaaagttatgccggtgccacctccttcttcaaactaaaagataccattacaagaataacaggattcgaatacatcattcctacccatcaaggacgggcagcagaaaatgttcttttctcttatctggtacatgaaggcaatatagtacccggcaactcacatttcgataccaccaaaggacatatcgaaggacggcacgccatcgcactggactgtacgattgacgaagcaaagaatactcaactggaaattcccttcaaaggaaatgtagaccctgccaaattagagaaagcactaagcgaatatgccgaccgcattccttttatcattgttaccattaccaacaataccgcaggaggtcaacctgtatccatgcaaaacctgcgtgaagtacgtgctatcgccaataaatacaacaaacctgtacttttcgactccgcccgctttgctgagaatgcctacttcatcaagatgcgtgaaaaaggttatcaagacaaatcaatcaaagaaatcacccgtgaaatgttcgatcttgccgacggtatgacaatgagtgccaagaaagacggcatagtcaacatgggcggtttcattgccacccgacgcaaagaatggtatgaaggtgccaaaggtttctgcgtgcaatacgaagggtacttaacctacggcggcatgaacggacgggacatgaacgccctcgctatcggtcttgacgaaaatacagaatttgataacctggaaacacgtatcaaacaggtagaatacctcgcccagaaactggacgaatacgaaatcccctatcaacgacctgccggcggccatgctattttcgtcgatgcttccaaagtgctgacacatgtcccgaaagaagaatttcccgcacagacattaaccgtcgaactttatctggaggcaggcatacgcggctgcgagattggttacatccttgccgaccgtgaccctattactcacgaaaatcgctttaacggccttgatttacttcgccttgccatccctcgcagggtatatacggacaatcacatgaacgtaatagctgccgccctcagaaacgtattcgaacggagagaaacgatcacccgtggtgtgcgcatcgcttgggaagcccccttgatgcggcattttaccgttcagttagaacgattgtctgtatagcaggtagacaagacaaatggcaatgaccttgtaagcaagctgaaaattctttataaacaaaatcaatcctcaagtgtttatattataatcaaacttaatacgtaaagttatggcagaagattataaattaatcgataatgaggagaaacatcggtatgaatttcagatcgatgacaagatagccaagatagactatatcaaatcaaataatggagaaatctatcttgtacataccgaagtccccgcttcccttggaggaagaggagtcggttcacagcttgcagaaaagacattggcggatatcgaacgacaaggtttacgcttagttccactttgtccgtttgtagccggatacattcataaacatccggaatggaagagaattgtaatgcgtggcattcatattaaataagtatagatatgggaaaaaaagttgaatataccaatggcgaactaaccattgcatggcagccggaaatgtgccagcatgcaggaatctgcgtaaaaatgttacccaatgtttaccacccgaaagagaggccgtgggtacaaatcgagaatgctacaacggaagagctaattgcacaaatcagtaaatgtccgtcgggagcattaagttacagactgaacaagaaagataagtaaccaaagataagcggtgaataatggtggaccattccactcattattcaccgtttatcaatatgcaaagatgcttcatgaaatagtgacagtccacgtcaaaacaaagtccggacaaatacgataaccgacggtgaacaattgctgccgttccgttgcatactcccgcacctggaataccccttcgctctgaggaatgaaatgtgataaacaaagtttccgaagatcagcgtcagcattttccattgatttgaagattgtctcctttgccgaccaatgcaacagcatactccaagtctcatctccctgataaggttctactcgctcgtcggaacggataaaacgatcgtatactcttttcacacgctgtccatattgctcaatatcaatgcctacaggagctacggaactaagtatcacagctacatacccctttgtatgcgaaatactgataaaagaagaattgtctgtcaaatgcggctttccttccgatgaatatcctatctctttatcttcctgcaacatggaatatagcagcacacggacagacaaccattccagtttccttcggtccgaagtaaaacgctgcatttcctgctcacaagaaactcttcggacatcgggcagaagactaaacagtgtatccaaagattcctccatcttccagacagaccactgcatatcaaccgttttatgttgcagaaataatcccatcgtttttggtttataatttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgattatagtttctccgcccgaacaggtcttatctactcatcactccttactctccgactcatccatctccttcggaagaatcgtgaacttaaccttcagaatacggcggctatccatctccagcacctcaaactcataattgtgataagtcaccttctcatgcaatgccggaaactcaccttttatttcgagcagcatgcccgccagcgtatcagcgtcacctactaccttttcaaattcatcttcatcgactttcgcaatcttatagaagtcagtcaactgtgtctttgcttcaaatatccatgtatgatcgttcagcactacatacgtgcgctcttcatcgtcatattcatcatgaatctcgcctacgatttcttcgataatatcctccattgtcaccagtccggaagtacctccaaactcatccaccacaatggcaatatgtatcttattcgcttgaaaatcacgaagcagatcatcaatcatcttcgtctccggcacaaaataagcagggcgaatcaatgattgccaacggaaattatctcccttattgacatgtggcagaaggtccttgatatatagcacacccttgatattatcccgcgaaccggaataaatagggatacgtgaataagcattttcaatgatacactgcatcacttctttgaaaggggtacggacatccagatcgaccatatcaagacgagatgtcatcacctctttcacagtctcaccaccgaagcggataattccttccaaaatattattttcctcagaaatttcagctttgtccgtcaattccaatgcatgagaaagttcatccacagaaatattatgattcttcttggcaaagtgcttattcagaaaagtggtagaacgcaccagcatagaagcaaccggatgaaacagtttctccagaaaatagattcccggagcggagaaacggcaaaatgccaatgtcttttgtgctgaataaatcttcggcatgatctctccaaacaacaataacaggaaagtcaggattacagtcagtataatgaactccgccaagggagaatgaaacacgaatacattcatgaagaagaagttgcagagcatgataatggtcacattcacaaaattgttagtgatcagtatcgtagccagaagccgttcggaatctccaaggagtgcgctgatcttttcgtcagcaggatgattgtgttcgtcaatatcattcaagtccgaaggagagagtgagaaaaaagctatttcagaagccgaagcaaagccggaagcaagcaggagcacacctgccagtactatggcgataatagcagagattgaaggagtgtttacggtaataccgttgaaaatttcagccaattggcttaaataaccatctgagtccaaagagtatgtattttagttaaacaaaagataatgtgccaatcagccatcagcctattgacacattatcacagtatctaaaacggcaagtcatctgccggattatcttgtatcggctgtgcctgtgacggctgcgcctgttgttgcggctgttgcggctgttgcatctgctgcggctgctgagcctgtgttgcagatggttgaggagctcccgcacctgtattagcccctttcggagacaacatttccatattgtccacaaaaatctcagtgatataacgcatagcgcccgactgatcactatatgaacgggttcttattttcccctccagatacagtttgtcacctttgtgcacatatttgtccacaatctcagccaaacggttggatgcaacaatattatgccattccgttctttcgggaatctgggttccattggccaatgtatagccacgatcagtagtagccaaagggaaagttgccactgccgaacctgtatcgaaatatttcaccctaggatcttgtcctacgtttcctatcaatatcactttatttactgacatacatgtatcaagtttatgattctattatttaaatctgctgccaaaattaaacagaataacaatagtatgcaagtattttaagtaataagtaaaaagtaggtaataagtaataagtaataggtattaagtattaaccattcggtttatagcgcagcttattacctattacccattacctattacttattacctactttttacttattacttattacctgaattaaggtctgcaccaacttggaaatcgcatacttgtccaattcctccaatcgtattctctgaaagttagcgaaggacttcgtgtcttcgggcaaagccacttcatacaggttggcatagatgacccgatgtgacaacacgtgcttcacaccccggcagactaagcgtatcaccggattctcacccgatgctattaatgacctaaattccggcaatgcaagaaactcctcttcggacaaagcaaccggagtttctatcagtggcagttcaaacaagttcttccatatatcgtttgccgtccgcttatttatataggtatgcgcgcccgcacgtacatagatataattaaagtaacggttcgtcgtctttgtcttgtgttgtttcaccggaagctgagtcacccttcctgttgaaagtgccgaacaactatccgccaacgggcaaaacaaacaatcgggtgactgtggagtacactgtatcgctccgaagtccataataccctgattataaagagccggctgtttcttatccagcatttcatccgccagagcagcaaacagtttctttccttccgtcgagtcaatcggagtatcaatgccgaaataacgggaaagtacccgatacacatttccgtctaccaccgcataaggcataccgtaggcaaaagaacagatagctgccgccgtatactcccctactcctttcagcgccagcacttcggggtatgtttccggaaaaactccattcatacttttggccgcagcatgcaggttgcgggcacgagaataatatcccagtccctgccagtatttcatcacctcatcctcgtcagcgtctgccaatgccttcacatcaggaaaacgtttgataaaccggagaaagtaatcatatccctgcgccacccgtgtctgctggagaataatctccgatatccagatccgatacgggtccgacgattctctccaaggcaaatcacgcttgtattctttataccattcaactatagcctcactaaaaatattcattcctgatttcgatctatcatctaacatttatctcgtatatactatccaaaagcagtacaaaagtaactcttttgtctctaagaaaacttaatgcctccacttttttagaaaaatgtgcagaatatatttttttaggagaccaaaaagctatatatttgcagtccaaaaaattagcaagaacctagtaataatattttttttaaggaaaaatgactaaagcagatattgtaaacgagattacaaagaaaaccggtattgataagacaacagttcttacaacagttgaagcatttatggaagctgttaaagactcattgtctaacgatgagaatgtataccttcgcgggtttggtagcttcgtagttaagaaaagagctcaaaagacagctcgtaatatttctaagaatactactatcatcattccagagcacaacattccggccttcaaaccggctaagacatttacaatttcagtaaagaaataataaacaagagtattaacccataaaatgtgaagctatgccaagcggaaaaaagaaaaaaagacataaaatgtctacgcacaagcgtaaaaaaagactaagaaagaacagacataaaagcaaaaaataatttttaagtctgatcaaacagaataaagaacaaacttgcgaagctacatgtctttcaagtttgttctttgtttaagtagctaaccctaaatgaacattttgtcaaaaaagttgttcatataaatgagattcaatcaataataagaaagcaaaacagtgacaagtgaaattgtaatagacgtacagcccaaagaggtctccatcgcccttctcgaagacaagagtctggtggaacttcaaagcgaaggaagaaacatttctttctcagtgggcaatatgtatttgggacgtatcaagaaattgatgcccggactgaatgcatgctttgtagacgtcggttacgagaaagacgcttttcttcattatcttgacctgggtcctcaatttaactcactcgaaaagtttgtaaagcagactttaagcgacaaaaagaagctgaactccatcagtaaagcaaccctacttcctgacctggacaaggatggcacagtggccaatacattaaaggtcggacaagaagtggtggtgcaaatcgttaaggagcctatctctaccaagggaccgcgactgacgtccgaaatttcgtttgccggacgctatctggtactgatcccttttaatgataaggtttccgtttcgcaaaagattaaatcgagcgaagaacgtgcccgcctgaaacaactgttgatgagcatcaaaccgaaaaacttcggtgtgattgtccgcacagtggccgaaggcaaacgcgtggccgaactcgacggagagcttaaagtcctgatcaagcattgggaagatgcaatggcgaaagtacagaaagccaccaagtatccgacgttgatttatgaagagaccagccgcgccgtaggtttgttgcgcgacctcttcaacccttcttttgagaatattcacgtcaacgacgaggctgtgtacaatgaaatcaaagactacgtgacactgatcgcacccgaccgggcaaacatcgtgaaactgtacaaaggccagcttcccatttacgacaatttcggtatcaccaagcagattaaatcatcgtttggtaaaacagtctcttacaagagtggtgcctatctgattattgagcacactgaggcgcttcacgtagtagacgtgaacagcggtaaccgcaccaagaatgccaacgggcaggaaggtaacgcactcgaagtaaatctgggagccgccgacgaactggctcgccaactgcgattaagagatatgggtggtatcatcgtcgtggacttcatcgatatgaatgaagccgaaaaccgtcagaagctttatgaacgaatgtgtgccaacatgcagaaagacagggcacggcataatattctgccgctcagcaaattcgggctgatgcagattacacgccaacgcgtgcgtccggcaatggacgtcaacacgaccgaaatctgccctacctgcttcggaaaaggtactatcaaatcgtccattctctttacggacactttagagagtaaaattgattatctggtcaacaaactgaaggtaaagaaattctcgttacacgtccatccgtatgtcgccgccttcatcaatcagggactcgtttccctcagacggaagtggcagatgaaatacggattcggtatcaagatcattccaagtcagaaactcgctttcctgcaatatgtgttctacgatacacatggagaggaaatcgatatgaaggaggaaatcgagattaaataacagaaaaggcggcccattcagtatgagtcgcctttttgtataaaagaggatgtccgtgggaaaaagggagacatcctccaacaggaaataggtaagagaaaggagtactttcgcaagcaccacctttccaactattccccaatgtaatcttcacatttaagtgaagaaagggttattattgcagaagtacggactttcacaagtacggacctcttaagattctcagagagaacaccttatataaatgatatatataaagaagtggggaaaactctctcatgagaaatagggaaattttaaattcttaatagcctttgtgtgccatatttactcagcaatacagatacttacccgattttcttcaggagtattatatggctgaacagtatcacctttataagcaactgtaattctatcggcagcaataccttttgctttcaaagcttccactacattattcgcacgtttttccgataatttgctgttgattctggcattaccagttcctttgtctgcatatcctgtcacgctcactttagcagtagcattcttctctaaatattctactagagaagcaatcttggcttgctgatcgtcctgaatctttgcagagtttatggcaaagaaaatattctgcttcaacggttcaatcaccacttcctttttgggttgcggttgttctactacaggagccggtttgggttgttccgtcactaccggttccggttcgtaatagaccggagcggttttagtgtagcttttacccagtctgatacttacaccgacaagggcattcagttgccagtcacagttaccggccttcttggagttgaacttatcagacaaggcgttggcattcgcttcgatgttaatagacaagcggtcattcaaacgaaggtcgcaaccaagaccgaaacgtccggcaacgagaaacttaccttcctgccagagatattccatctcataagtacgggtatcgagcgcatttgcttcatcgttgtcaaaaccacggttcagccctgctccggcaaaaagatagccattgaacacacgcttcggattgaaaccacagaacaaagtactgagatccgccatgatgtctacatttccttgcagatatttatattggtaggtctgttgcggattcacccatcccccctttgcctgccagccacttacaccaacacgtgcgccgaatgcgggagcaaacttataaccgacattaagagctgctgccggagaaataagatcagtgaattttgcttcacctacggtatgggctgctcctatttgtgcttgaatgaaccaatgaggtttgaaagaaatcttttcaggttccttgatacgctgttcctgggcggaaattggcaatacactgatagccattatacctatcaacagttttcttctaatgctcataattgattaatttacattaaacataaagcgcctctcattagagagaagcgcttcattatatttaagttcaaaaagaattagttacctaatgtcttttcaaccgggataatcacataagacttaactgtaccccacttgtaagtgacagtaacaggtaatctcaagttgaatgcaccgacagcgttaccattgtttgtatatgtaacggtaccataagtatccttagcaggagctgcaggaataggattaaccgtagtaccagtttgagtaattaccagttgtgaagtaacctcagacaacttcttagaattgatatcgttaccattcaagtcagtagtaatattaggtatatcaactgtaattagctcgattccataataaccgaagtagttagcttttactgttgtgctgaatgcttggtttctccaatcagagaagctcaacaggtcgagcatattaactgtagaaccattatcaacagcatcttggaacttaccttcaccggcaattacatcaatcggacgcaagaagtaagccatatattcaccgttagtgataggcaactctaatgcacattcaccggtagttgctttaatgttaatccaagcatagaatccggcagatggaactgagttgtgacttgcaatattcaacaggtcttttgcaaagtctgtattttgataagtgactacaccatcagcatcaatcactgctacattttgagtcgcagcaccggcagtagctttcaatgtcaagccatcatcactaactgataatgtatattcagtaccgctcaaacctttctctttacgatttacgttcttagatgcaaaaatatacttgtaagcagtagcacctgtgataataggtttgtttccttcaaatgtgttatccaagtcaactgcaaatgcacagtcatcagtcagagtacccggaacaactacattcagacgaacgtaagtcttattagcatcccagtattcagcgatcttgttagaagcaggaattgtaacagcggcaattgcattaaccttagtagacaatgtgatagttacatcgctgtaagaatcttcataaccagctttcggtttgtaagttacaacagccttcaatgagccaacatcagaagtcttcgccaaagctaacttcatatcggcctgagaaatagtccacttcaacaagtcagtttgtgtaacttctccagcatcggcaacctcagtaaccacaccatcgccggtatacaacggattggcagcttcatagatagtcttgaacatcttatagtccatacccaacttgttataaaccttcacattcatttgttcaactgtcaatgcgaatactttatcatcacattggttagtgaatggatcaaatgtgaacggagcgtcaatagcaggagccttatctttagtgatcatcactttaatccaacctgtgctgaccactttattattagctttcgtatccaacagctgaacacgtaccaatggctgacgacctacggcagcatacggagtagctgtttcattaaacaatttcggatacaaaaccgaacctgtcaatctagcgaaatcactttggttagtctgattagtaccatcaatataagcacacaaatggaaatcatacttcaagcctaattttgccagttccgcagcagacatagtcaaatctgttttattagcagccacgtcatcataacaagtgataactttgtcagcaagatcgataccggtagttgagttataagcaacttcatagtctgcgtcagccttgatagcatcatctgccttaccagaggttgttccatacaagtgatgttgtgcagcagctgcagcttttttagccttgtcacccaaaatcacgttttcataatctgttgcgtagatagctctatactcatcagtaattgtattaccagcttctgtttctacacggatagccaaaacagtaatcttagaacttgagatagcttcaatcaactcagtagtagccttgaagtaaacagtcaaaacaccgtcttttacttcatagctttcaacttccggattagaagcagctgctctagttttattaatatactctttatctgcagaaagtacagtgatcttcttaatctgttctttagttgcacttgacggattcagataataagtacccgcaataaccggacgaacataagaatttgtagtagctttttcccatacttcaccagtagcagtagccggattacagctagtggtttcaccccaagctttgtaaacgactttcaaagccttcattgaaggaacgcctcccagataagcatccggttcgaagccaaagcttgtaataggcaacacatcacagatcatcaaattaacaggttctgcattaccatatttaatagcccagccataagttacgccatctgtagtcatttctgtgatagtcagcgtaccttgcttaggtattgtaaccccggtagcaacaccgtcatattttacaacgccatcttcaccaacagtcaatttggtagcatcaaacttggtatcagtgtcagtatctgtaaaagtaatagtcttagtctgtttattacctttgtcatcggtcaaagtaatagtagctttattaccatcctgagatacatccaaagtgtacgtagtattcgtatcgttatcagggatcgtataagtagtaggagtccccgattgatctgttactgtcaatacaccattagcaaaggataccgatttcacataagccaatgctccgaacttggtattcaagtcagctaatgttttttcgactgcatccacacgttcgctcagaccattgatgtcgtcatcgtagtctttacaagatgtaaatgtgcccgtcgaagacgctaataacgctccaaacaggactgcatttaaaaactttttgttcataataaaaaaacttttaatttataaattaaataataaaaatataatctctcgatgtcgattcaataatcccatgtgttgtccccattcatttttagtgtaacctccttttctttttttgttttacctgtgtccatgctccatagaggatgaacaagaaacttactcccaatactttttgcccgttacttcataggtaacgggcaaacctttgtcctggctctcatgaagccttctttatgaaaaactgtatgatttagtaatgaaacttatttacccctgcttcaaagaggaggcagaggggagggaaatctttgaatataattagaaggttataaaggtctaataaaaagaaatccgccgttttatcgtgttatttctctttttttagtagtttatcagaaaaaatatcttttttgtttgcatgttttccaaaatatctccatctttgcaacgctgtttagctccgttacctatgaagtaacaggcttaaattcaacacattgctattggaattgagcgctttataaaatccaccacctttttattggcttcatctattttcttattccgaaaaggtttgagatacgtctcggtcactgtgatcgaagagtgtcccatagcttcagaaataacgcccgggtgaatttcacaatagtaagctgtcgttgcccatgtatggcgggcagtatacgaactaagtttatcccccagtcctaacatttcacctagcaacatcagttgtctattgaaattgcggagtgccaactggtattcatgataagcctccttcgtcccttcccgactatttaataacggaaataaataaggagatgacgtatcacgattcatatacctctttaatatagccatcgcttccggagtcaaagtcactgacaaagggcgcccggtcttccgcctgcggtaagtaatcacattgtcgtgcaaatcacttttacgcaaataagcaagatcgacaaaaggcagaccacgaagcagaaacatcaaaacgaacaattcctgcgtacgacgcatgtcagatgtcacagcggacgactgcggcaatttggtgaatactttctgtatgtcttcggtatccaatgcacgcttacggtccgcacgggtgccggtatatacagaacgaaacaaatgcggtacataaacagccccacgacaatctaccgcacgattatagaccgcacgaaatgtgcgtaaataggtggaaacagtgttccagctacatccccggccacgaaggtgaatctcgaagccttttatccactctggggttacttcattgaacgtaaaatcccctttcccacgataagcaatgatggcattgagactgctacgataaacgtgcgcagtaccaaagtttccccccatctgtagtcccttggctacttgcttcataaatgctactacttttaacattttaatcactattaaataaattacgcgataaatataagagtattttcgtaaccgaagccacccaatacacatatattcattgattttagagctgtatggacagtatgttaatcaatgttcgatctgtataataacaaaaagaaggtgtgtcaaaagtaactaaatttccctccttcaggaaggaggggtggctgaaagccggggtggtaggtgtacttcacagctgaagatcaatagcttatatattcacctaccacctccccctacgggtactcctccttcctgaaggaggagagtttagttacttttaacttttgatacacgtaccttcagatacaaaaaaacaaaagaggatgcctccagggaaaaaagggcaggcatcctccttggggcagaataaggtacactttcacaagtataatcttatactgttaccccctgatacaatttcttcacattcaagtgaagaaaggggtctattgtggaaacacagactttcacaagcccgcacttcctattcatctcatgtgaggattctcgtacgaatacgaaaaatgtgggaaaaaacacctcacatgagaatagggaatatcttttttaagaaaagagagttataatcacaaatattattccgctatacagatacatacacggttttcttcaggtttctgataaggctgcaccgtatctcccttataaccaataacaattctatcagctaccactcctttagctttcaacatctcaatcacattctttgcacgtttttccgacaaagtcatattgatattcgggttaccggtttccttatcagcatatcctgtcacacttaccttggcggcagaatgtttctccagatattctactaaagaactaatcttggcttgctgatcgtcctgaatctttgcagagtttaaggcaaagaagatattctgcttcaacggttcaatcaccacttcctttttgggttgcggttgttctactacaggagccggtttgggttgttccgtcactaccggttccggttcgtaatagaccggggcggttttagtgtagcttttacccagtctgatacttacaccgacaagggcattcagttgccagtcacagttaccggccttcttggagttgaacttatcagacaaggcgttggcattcgcttcgatattgatagacaggcggtcgtttaggcgaaagtcgcaaccaaggccgaaacgtccggcaacgaggaacttaccttcctgccagagatattccatctcataagtacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattcccttgcaggtatttatactgatagttctgacgtggattgacccatcccccctttgcctgccagccacttacaccgacacgtgcgccgaatgcgggagcaaacttgtaaccgacattaagagcagctgccggagaaataagatcagtaaattctccttcacctacagtatgtgcagctcctatttgtgcttgaataaaccaatgaggtttaaatatcgttttactttcttctttgatacgttgctcctgcgcaaatgctattgtagtactcaacgcatatacagcaactaatattttttttatattcataatcaaaacctgtttaaaagtctaaaaaccaatgacaacagtactcgtcaccattcatctactacttatcagtagcttccttggtagcctctttaacggcaagataccaaactccgtctattttcaccggattaaacataaatccaattgtatttggcgtatgatcatccgaactagtgtgcttgaaaaactctatctgaaacttcacatcgttattatccgtacttgaaaaagaataataatccaatttataatctacaacaggaaaatacttgaattttttcctcagttgttgttccttctcagcgggaagaggtatcgcttttccatcgcgcaagataaaaagcatcttcagcgcttcatctatatttccggctttcaatgtatccatgcaactgcgtgatatggtaagtacttgcaccgtatcttcagctgtcaaccccattaagaattcttctttgggagtgagctgcttctttttttctccgcatgagaacaagaaacaagaaacggcaaccaacacacatatatataacagatctttctttttcattccgccttcaattcttattgtgaaggagggtgcaccaatgatcggcgcaccctccttatcagtgtttagtaatgaaacctttactattagttacccattgtactcttaactgtacaatctactgtagtcttcacagtaccccaagtataggtgaactcaaccgggatgcgcagttcaaatgtctgaacgttgttaccgttgtttacatacttgatcttacccatagctgcaacaattgcatcatatgtagcttgagtaccacttgcttcagtattataagaagaaagatttaaagtagcagaagtaactttattaccatctttatctgtctgagtcaatacgattttctctgttttgcttgacaataaagtctctcctagcttaccaccacttaaggtagttgtagcatctgctattttcacttctaccttattcaatccgtagaatgcatacaaccagctgtttgaatagtcagttccatctacgaacttaacattacgccaatcctggaagttgaacaacttagcgatatccagagtagaaccattagcatgagcatcaacgaattctccaccatctgtacctactgcgtcgataggacggaggaagtatgcattgtatgtattgttcgtcaaagacattgcaatgttgcaaggactgtatgcacaaataccgatcttagcaaaatgcttagcagcactatggctatatgcattcaacaacttcttagaagtatcattgttttcataagtaatcttaccggtgttctgatcgattgttgcaataacagttccattagcatacaacttcgtattagtgaatacacctgcatctactttcaaagcatgatcgatcatgttctgagctgtagctttatatgaaccgcctgtaatacaaggtgctgtagcattatctactgacaatgtatacttagttccatcaacagtcaatacattctgatcagcgtcgaagtaatacttataacctccggcagcgccgttttgatttgcaaatattacatcagtataagaagcaaagtttgcaggaggagtaaatgtaggcatacccttttcccatacctggttcaagtcaactacataattcaatgtattgccgttatcttgcggataaggaacattcagacgagtattctgaccatccttagcaacgtcaccgtcactgtaccagtagttagtcaacttagtaacaacagttccctgaggtttagcgacagctatctgcaaaggcatgtagataggagcatgagatgtagtattcagcttgctgacatatcttacataaatagtagctgtatgacctgccatttcataaataccagactgttctgcagtagtcaaagtccagtgaagaactgtatttgttgtaccagtttcatccaccttttctttcactgttccaataacctgtgcaatcgcagccggaacgaatgacttaccatcggctgatttagcaaactgtttggctacaccactatcatctacatcgaattcatataaagcatcgaattcatccttagactgaacagctgctttttcaagcaattgataagaaatctcagaccatgtcaagatagcatcagcctcatcacatccaaagttgtgagtgcctttgtcgaatacacttgtaacgatatcatcaacctgttttgcaatttcaattttaatgaatccagccaagacaacgcggccatccgcatctgtcacacgtactctaaccaacgggcgttttcctacagaagatacaccttgctcgttaagagtctcaccggcagagtttacaatacgcggagtaagtacaccttctttaatagtgtttgcatctgcatatttactgtcagaagttacattttgacctgatgtatattgaatgaacgcgaagtcatacttcaaaccatacttagcttcatctccataagcccaaactttatgagtaccatcattttttgttgcttcaggctgaccttcacgattatagtgaattgtcaacagattcttcaaatcaataaagctattataagcaactgtcaaagtaggagcatgtgtgatagcaccttctacagtcttgaacaactcgtccggattagcagattcccggcaatcttcagcagctaaagtagcatcattaaatgcaatagcctgaggagtaaccttagaagcataaagcaatgcgtaatcagatgttacagttgtatctgcctgagcatcactttttgctttaacaattgcctgcaaagccaagatagaaccttcgcctccttgtttgatgtcttttcctattgctctgagtcctaccggaaggataccttcatcagcaggtttcatgtcagcgacttcaggaagagccactgaagcacgagaagaaatcacttcaacatctctggatacaaaagacaaatcttccttacttacttttgcactagacggattcaagtgataattaatatattcaatcggattatattgagctccggtaccacctgtatagttccattctttcgaatcagtaattactttacacagaactttctctgcttgctcatcttcccattgagtagtagctgcagtgcttcctgccttatatgtataatccaaataaggatattcgatagcttcgataccgtctacaaacaaatcagatttgaaaacaagacctttcagagtcaatacgtcattcaaagcaaatgtaacagcctgatctttgtacttaatcgtatagccgataacaacgccctcagcgtttttcttatcttcaatactaagaactccgtcaccaggtatagttacaccagtttccttaccatcatacattactttgcctgtcgtaggatccactgtcaatttagaaggatcaaaagcatcaggaatggttggagttgtaggagcatccgggaatgtaatagtaccggacgaaacaacttcaccgtctttcaacagcgaaattttaccttccttatccacactaattgaataagtcggcaaattctgtccgatagtataagacacactgttgttctctccatctaccacagtcaattttcccgtagccggatcataagtaacagactttacaaaagacccaactttggcctgcaaatctgaaagactttttgcgagttcatcgattctgccgtttactgcatcgatgtcgtcgtcatagtctttacaagacgtaaatgtacctgcagaagacgccaacagcgccccaaacacgactacacttaaaaactttttgttcataataaaaaaacttttaatttataaattaaataataaaaatatagtctcgcattgttgatttaaaactctcatgtgttgtccccattcattttcagtataacctccttttcttttttgttttacttgtgttcatactccacagggggatgaacaagaaacttactcccaatactttttacccgttactttgtaggtaacgggaaaacctttgtacctgccctgagagggtagataatactgaaaaatcatttgttgaatgctgaaacatctttacccctgcttctaagaggcggcagaggggagggaaatctattatctaaaattaaaagctacaaaagtttaatgctaagaaatccgctgttttatcgtgttatttgtctttttttagttgtttatcagaaaaaatatcatttttgtttgcatgttttccaaaatatatccatctttgcaacgctattcagctccgttacctacaaagtaacagcactaataatcaagctattaatccagtaactatccgtttcacaaaatccgttaccagttgattggcttcatcaattttcttatttctaaaaggtttcaaatacgtctccgttaccgtaatggacgaatgccccattgcttcggaaataatacccggatgaatttcgcaataataagctgttgttgcccacgtatggcgtgccgtgtatgagctcagcctgtcgcccagccctaataattgccccagcaacaacagttgctgattgaagctgcgcaatgccaactggtattcacgatacgcctccttcgtcccttcacggctctccaaaagagagaacagataaggagaagaactgtcacggttcatatacctctttaataagaccatcgcttcccgagtcaacgttactgacaggggacgaccggtcttccgcctgcgataagtgatcacattgtcgtgcaaatcacttttacgcaaataagcaagatcgacaaaaggcagaccacggagaagaaacatcaggacaaacagttcctgtgtacgacgcatagcaggagtcacggcaggagacgaaggtaatttggcaaaaaccttctgcatatcctcatcacacaacgcccgcttacggtccgcacgcgtgccggtatatacagaacgaaacagatgcggtacataaacagccccacgacaatctaccgcacgattatagaccgcacgaaatgtgcgtaaataagtagatacagtattccaactgcatccccggccacgaangttttcccgttactctgtaggtaacgggaaaacctttgtacctgccccaggagggtagttaatactgaaaaatcatttattgaatgctgaaacatctttacccctgcttctgagaggcggcagaggggagggaaatctattatctaaaattaaaggctacaaagtctaatgctaagaaatccgctgttttattgtgttatttgtctttttttagttgtttatcagaaaaaatatcatttttgtttgcatgttttccaaaatatctccatctttgcaacgctatttagctccgttacctacagagtaacaggttaaaaatcaataaattgcaaaagacattgagcgctttataaaatccaccacctttttattggcttcatctattttcttattccgaaagggcttgagatatgtctcggtcactgtgatcgaagagtgtcccatagcttcagaaataacgcccggatgaatttcgcaatagtaagctgtcgttgcccaagtgtgacgcgctgtatatgaactaagtttatcccccagtcctaacatttcacctagcaacatcagctgtctattaaagttgcggagagccaactggtattcgtgataagcctcctttgtcccttcccggctatttaataacggaaatagataaggagaagaactgtcacggttcatatacctctttaatatggccatcgcttccggagttaaagtcactgacaaaggacgcccggtcttccgcctgcggtaagtgatcacattgtcgtgcaaatcacttttacgtaaataggcaagatcgacaaaaggcagaccacggagcagaaacatcaaaacgaacagttcctgcgtacgacgcatgtcagatgtcacgacggacgactgcggcaatttggtgaatactttctgcatgtcttcagtatccaatgcacgcttacggtccgcacgcgtgccagtatatacagaacgaaacagatgcggtacataaacagccccacgacaatctaccgcacgattatagaccgcacgaaatgtgcgtaaataagtagatacagtattccaactgcatccccggccacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaatctcgaagccctttaaccactcaggggttacctcatgaaatgtaaaatcccctttcccacgataagcaatgatggcattgagactgctacggtagacgtgcgcagtaccaaagtttccctccatctgtagtcccttggctacttgcttcataaatgctactacttttaacattttaatcactattaaataaattacgcgataaatataagggtattttcgtaaccaaagctatccgatacacatatattcattcattttagagttgtccggacggtatgtgaatcaatgaccggcatatgaaactaacaaaaaagaaagctggtatgtttcagtaggattccccacaaaatataattgcagacagataaaatcatcattatcgtaacaagcagacagaagattcattatctttgtggagtcgcaaacaactaataaacagaaataatgacgaaatttattaatccatttaccgatgtaggatttaaaaaaatcttcgggcaggaaatgaccaaagacttgttaattgatttcctgaacgacctgctggtagatgaaaaacatataatagacataacctttctcgataaggaaatactgcccgagtatatgggcgaccgaggggtgatctatgatatatattgcactgccgaaaatggagagcaattcattgtagagatgcaaaacaagcagcatgtacactttcgtgaacgtgccttgtattacctttcaaagactgttgcccggcagggtgagaaaggagccgaatggaagtttgacctgaaagccgtatatggtgtgttctttatgaacttccggttggacaatttgccgcataagcttcgtacggatattgtgcttacagatcgtgacacgcacgaacaattttccgacaagcttcgttttatttttatcgagttgcctgctttttcgaaggaggagcaagagtgtgaaactgactttgaacgatggatttatgtactgaagaatatggaaacgttgaaaagattgccattcaaagcccgtaaatcggtttttgagaaattagagaagatcgtagatatcgcttcgctttcaaaagaggagcggatgaagtatgatgaaagcatcaaagtgtaccgggataatctcgtgacgctggaatttgcagaacagaagggacgtgcagaaggcaaagaagaaactgcccgaaacctgaaaaagatgggagtttcactggaaatcatctccaaagctaccggattgagcatagagaaaatagaagcattatagttgttaccgtctacctgtagaggagtgctcggtaaatatcccatattgtaagatgaagatcaaaggttaactttaagtttgctttgatcttcatctttcttatttaatgtaagtttgatatcccccctcttcctttatcggaaacaaaattgtatagtaaaaacaaaaaaagaggatgccactagggaaaaagggcgggcatcctcttaaggggacagaataagatgcactttcacaagtacggtcttacgctgctactctccccgatacaatttcttcacatttaagtgaagaaaggggtctattgcggaaatacagactttcgcaagcatatatttcctaatgctctcacacggaggttctcgtacaagtacgaaaaaaaatgtggggaacaaacactccgcatgagaatagggaatatcttttttaagaaaaggatcttcttaatgtagacatcattctgctatacagatacaaacacgattttcttccggtttctgataaggctgtaccgtatctcctttataactagtaataattctatctgctgctattcctttagctttcaaggcttctacaacatttttggcacgtttttccgacaaagtcatattaattttcgggttaccggtttctttgtcggcatatccggttacagcaactttactggttgggtttttctccatatatttaatcatagcatcaatctttgccaactgatcattttgcagaagtgcagagtttaacgcaaagaatatattctgtttcatcggctcaacaactactacaggtttcggttctggctcttttgcaacaacaggttccggtttaggctgttctacgactgcaggttccggttcgtaatatacgggagctgttttggtatagctttttcccagtttaatggtcaagccaacgagtgcgttcagctgccagtcacagttaccggctttctttgagttgaacttgtcggataaagcgttggcgttagcttcgatattgatggccaagcggtcattcaggcgaaggtcacaacccaagccaaaacgtccggcgacaagaaacttgccttcttgccagagatattccagttcataggtgcgggtgtcgagtgcattcgcttcatcgttatcgaaaccacgattgagccctacaccaccaaaaaggtagccattgaaaacacgtttcgggttgaagccacagaacaaagtgctgagatcagccataatatcaatgtttccctgaagatatttgtactggtaggtttgttccggagttacccatccaccctttgcctgccatccactaccaccgatacgtgctccgaatgcaggggcaaacttatatcctatattgatggcggcggcaggagacatcagatcggtaaacttggcttcgcctacggtatgtgcggctcctacttgtgcctggataaaccaatgaggtttgaatacggttttaccttcttccttgatttgtcgttgctcctgagcaaatactactgtaccactcattgcaagtatggctactaataaatttcttattttcataatgttatgtatttaatgtcttgttacagaaatctcatacgatatgtcacaactatatatcaggcaaatcttatcacccaatatatgctttgttatatgaaaagggtgctctgactagagcagagcacccttcctgaaataatatgtgtctaaaaattgatagacaacattttgatcttttagttcttcggattaactgtaatagtcaatgtggaagaaagtgttccccaaccgtagtttacagtagcaggaataaagatcttgtaagcgtattcaatcggtgaatccacatttacatacttaacggtattaccaacttgttctaaagtagtcttagcaggcagcttaccaccattgtatttcaagtctgtagtaactttagtaatatcaagtttcacatcgctgaattctccataatagaaccagtattgtccgagattaataactgagctaccgaatgtagtcttagtccattcccaacatcctgatttctgaccataagattctccatcaaatgtaggcataggtgtatgttcatgctttttagcaacgtagtcaccaggaacaacgactatttcagccggaacataatcaatatttgctacataggtatattctacatgagaaccctttatcacaggaatttccgtaaaattataagttgaaccgaagtttacatatccttcaggagttccctcacgttcttgtacttccagcatagccatcgcttcagcctgagtcaacattgcacctacagaataggttttttctatcacatcctcggtagaagttcccggtttccaataattaaccttagatgttccactatacatagtaagatctgatgcagtaacgaagtcaacttttccataagtaacattcagactagccggagttttcacatagctatgttctggaacccattcatattctgttgtacaaacttgtttccagtatgaagaaatatcttcagtttctactacactcggagatacaatagcattaccgctccaatccatcaacaagccattccactggaagttagcaacatcaccacctgttatagcgtctgtcagagtaactccactaggcatattcaagcttacaggacggatgaaattaaccataaattcattgacagtaatctgatcaccgctttccaatgtatagatatgtgcaacagaagcttgcagaccgcctgcgctattcaaagcaagcttaacatcagcatcattcttatccaatgagatcgtttttccactgatcttaacacctgctaagactttgcttgtagcaactccgttagaataagtcttagttacaacataacggtctgttacacaatttggaagtccttttacgttatatttatcgtaagcaagattcagttcttgatggatctggcatccgtctgcaggatcttccggagtattaggtactacagcattcaccttaaagaacttcatatcaccatcaatagtctgccaatacagttcgttcttcactgcatctaagctagctttcggcaatttcacatttacagcaaacttgaatgtgattgcatcaggatatttagaagattgcagtttattctgaacagtgatagtagcaacaaattcagaaccagtagcactaatagcaccaagctgaccgtgtttgaatgaccagacaaccttcttagttgctgtacctactgaagtagcaccagctacaattttcgggaaatcaacaccagttaccagtttgccattcttcttaacagatgcaacagcagtagaaacatcgtatgtattccagaatgtctcatgactcataccaatattagtaccatcagttatcttacgataaacattctcacggatatattcttctgtaatagtatatgttgcttctgtatcagcacatttgaataccaattcttcagccggattacctaccgtgaaatcaggttgtttttctgcagtgaatttaattttcacaaatccgcgacgtaccacgttgccattttcgtctaccaattcaactttcaagatcggagtacgaccaaatgcttccggattgaaaccttctgcctggaacaaacctttctcaacatcattacacttaacccatttctgctgattagtttcagttttaccttcttcaagattaaaatccgtagtagctacagcaaatctgtatgacagtttataggcttcaatcgggaattcatcatgaccagtagatacattttcattattgagacaagttgcaaccagttttttcaagtcgaatacttgatcataaggagtctcgtagcgaggttcttctttcgtacaagcatcgaatgtagttgcataatgagcagcattaccaccttcaaacaaagtttccttatcagcgatacgaacatcttcagcagccaaaatattatcatatacagctacatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtcaacagttcctgttgcggggttagcaaccggttcgccaacaatctcaaccaacttacttgcagcaattgcacgagttgtttcaacaacttctgcagtgcggtcgatatagctatagtcagcatttgccaacttaaagcttgccggattgaaatgatagctagcagtcgccaaagcagctgtagagaattgatagctctttgctgggatgctggcattttcatctttcacatccattggagaatattgcaaggaagtgaatcttacagcttcaataccgtcaacgaacaagtcgggagcaagcgagatgcttgacagacggcaagttaccaatgtatgcagaccagtcaggttcgtattgatatttccaatcttagtattgatttctttaatagaagcctgaatgtcttttacattcttcttaatagcatccaattcatctgttatctttgtttccagatcactgatagcggttttatttgcaccgatcaaatctttcagaccgcctttaccatcaatttccttccacaaagcagccaaatcatcctgtgcagctttgatatcatcctgtgctgctttaatatcctctgcattagcatcaattttagcctccagcgttatcttaacatactcatcgagttctttcaatgttgtagcaaagtttgcgtctgctgtctgcaatgtttcgataaggtccatagcagttttgatagcctctgtattttctttcacagcaccattttccaatgtactcagaccagcttcgataccatcgatacgagcaccaagaagttttgacgcttcttcgaatgcagtaacatcaagtttcttgtcgatagcttcctgcattgagtttctcaaagcttccactaattttgtagcctctgcgatagcttcagtttttgctgtagcagcagcagcttcggcagctttcgctttagccaaggcatcagcagcatcagctttggcctgatcaccggcagcttttgcagcatcagcagctgttttagcttctacagcagcagctttagcagcatcagcagtagcctgagcagcttcagcagcagctttcaaagtagtcagctgagtctgaagatcagtaatagtgcttccgcttttgtcaatttgttcttgcaaccccttgatgtcatcatcgtagtctttacaagaagtaaatgtacccgctgaagccgctaatagcgctccaaacaggacgacacttaaatactttttgttcatgataaaaaaacttttaatttataaattaaaaaaataataaaaatattgtttctcgttttggattatgaattcccttactacatctcatgttttattcctttcatttcttgattcttcgccgcccttgcacacatccaaaaactaccttaagaagcatttgtaaatccaaaaagaaaaaattatatttgttgtgatttaaaagaaatagaaaccagacagagtttaaattacactccccaaatggggaagagcgggtgaagggcttcctgtttcatggctctttcattgttctttatattttaaatccaccgataccctgtaattacccggaaccggagtatatatcggttgatagatcgtccctttattttgcaatttcttttctgccattaacctcttgatatggcgatatgcagtgatttgtgtcattccgcagagatattgaaaatctttccgggtgataatctgattttcagcaaaatattcagttagtttcatgtctatttctacttctgataaattggcggagtgcggtctgattttagaacgctggaatttcatgtgacacaattcccctttcaattctttatcagctttaaactttatagctttcaattttacccggtgcacacgtttgtctttcgggttacgtatttcttcttcgcaggaaagagtgacctgaaagaatcctaatccatcgacatgcacctttttaccttccaggaggcactgagctacttcatttttcagttcttccaaggttgaaataatgtccgatactcttaatgtggagcgatcatggatgcgataagccagtttctcggtattgacggtctcaaaacttaccggacgggcatgataacgcgtcttgttctttttctcctttggcatcggagtcttatataattcaaattgtactgccatttctgctttatctttaaatgatttcttgtttttagtgctgatattttatacttatcattactatgataagatcttatcacaataatgatgttattttatcatagtagtgataatatcttatcacattggtgataaatataatttgtcggtgacaaagataaggtttaatagtatgataaacaagaaatgataggatattaatgataagtctggttttcaaaaaatgaataggatgaaaagttgcaaatggcttttttttgatattatattcgcatccattaatcataaaaaaaagaagaaaatggaacaaaaaaatggttggtttgccttttggcaaaaattgatgaagtgtctttcaaaacaagatgaaacgggagtaggggatacaaaaagtgtagcacctgtcaatactattattcagtcgattaagggggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcgaaagtgaagtcactaactgagagcgtagatacttttttaaaatcccgctatgatttccgctacaatgtgctgacagaagaaacggaatatcgtttgttggaacgaatggaggaaggatttgcacctgtgaatcagcgtgtcttaaatacattctgcctggaagctcacgaatcaggtatttcttgttgggatcgtgatctttcacgctgtattttctccacccgtattgcagagtatcatcctttcaaactttatttggaagaattgccggtatgggatggagtggaccgtttggcggctttggcacgcagagtttcgagagaccaattgtgggtgaaagaattccatatatggatgcggggtatgacagcacaatggatgggggttacgggaagtcatgccaatagtgtggcgcctttgcttatcagtacggagcaaggatatttaaagtctactttttgcaaatcgctacttcctcctgcgcttcagcgttattatatggataaggtggatttaaccagtcaagggcatatagaacggagattggcggagatgggacttctcaatctggatgagtttgataaatatgctccgacgaaaatgccgttattgaagaatctgatgcagatggcttcattaagcctgtgcaaagcttatcagaaaaattatcgctcgctacctcgtatagcatcttttatcgggacatcgaatcgaaaagatttattgactgacccgactggtagtcgcaggtttatttgtgtgctggtagagtatcctatcgattgtgaggggattgactatgcacaactttatgctcaattgaaagcggagattttggcgggtgaacattattggtttacaaaagaggaagagacggaattgcagcaaagtaacatgacgttctatcgtcagggacctgtggaagacgtattgcgttcctgttatcgggcggcagaaaaaggagaagggtgtgaacttctttcgtctgctgatatctttcagcgattgaagaagataaatccggcagctatgcgtggggcaaatccggcgagtttggcacaaatactgatagcagtggggatagaacgtaagcataccaagtttgggaatgtgtatcgggtagtctccgtctgatgggaggtgaagcggatggtgaacaggagaccttcacccgcaatcgtcgtgccagagggagttgtgaagggtgaagggaggaaaggagatttgcttatttgggatgaaaaattgtatcctttttggggacactctttccttttctttttcgttttttcttcttatcttgcgaatgataattcatctcatgtaaaaaggtgaagtagagagatgtttgattatggacaacataaaatttaatagaaaatgaaaaacattattttaatagtaagtttattattgatgggtgtgagtagtcgggcagacatattgaactcttctgataataagaatgtggcagataaatttgatccgatgcttaaagcagcgttgttccaaatgaagattatagctgataccagctctattttattatcggatattgattacgtggaggatttggagctgaaaaccagtttatggattaataatgacgtgaatagagcgaaaactacgagacatgaaattacctcattaaaaggccttgagtatttttcttctctacgtcggttaaagttggtgggaaatcggactgatacattggagtgtattcctgatttttctagatttaaagaacttcgtgagttggaaattatacaaatctaccttccgaaactggatataagtggttgtaaaaatctcacgaatttaagttgtagaagttgtgatttgaatacgatagacttgaaaaagaatattcaattaagaactttagattgtacttataaccgactgatagaattggatcttagtcataataaacaacttcgaacggttattgttaaatctcaaagaaataaaggattactttcggaaggaggtcgtgccgggatattatctaagttgattcttccggataaccgatcgaatacagaaggaataagtatacttgaatgttcggataataatctggagaaattggatattagtcgatcaccgcatcttagaaaaataaattgtagttggaataagctaaaagcacttgaaacatcacataatcaagaattgcgggaactaaattgtgaagcaaattatattggagagttggattttagtgctaacctaaagatggaatttttaacttgcggattgcagggatatgagtggatacgccaagaagggaatgattatcgtttattgaagaaattgatactccctgagcaaaaagagaatgtggaaggaggttcgctgcgtaaactttctattaaagaaatatcagaagaagcaattccggtttttagtgactacccttatttaaaagaattaaattgtgctgataacagactaaaaacaattgatcttagtgcaaatatatatttggaggttttggattgtagtagtaatgctatatctcagcttgatttgcattcaaatgtcaacttgtattcgttgaatattttaaattgtccattgcaagtattggacttgtcccagacaaaagtgaagctaattatgtgtgatttctatgatagaagagagaagggtgtgaaaaatggatacatatctggtttgtatttaaaattgattgttcctaaaggataccatgctgaaactataaactttagaacccccaccttagaaactgcctcttttgaaaatggctctatatataattatttacctccacaatatgtcaggatggtagtgtcaggaaaatagatacaaaacctgatatagcagataaaaaacagctggaaatttctggtaatggattatttttaaacctattgagtgatttttgaactctttattttgtatcattttaaggaattggagtattttgaatgatttgagtactcatttcttttctatttttatcaactttgccactgtgaatcattcgatgatttgcggtggcttttaaattttaataaataatagaatagacatgaattgcacaaagatgaaaaaactttttagaaaaggtacgttgagtatacttcttttaggagtaataacgtttttcacttatccgctctcagcccaaacaaatagtagatccggtaaaggattatatgaaatctttagtactaaaataccggacggggcgcagtggaaagctcaggataataaatttgtccgtgatgggggatactctaaaaaatcagaaaattatatatatgtaggagcctctaaaagtccggcagagttgaccgggctatccattcctattcgcgagaatccgggaccgggtgagtttcgctatatcacttttgcctgggtaaaatggggaggtgatcaaattggaatgaaatttcatgtttccgaaaagtctgcaaatcaaaaaggcaagaaatatgattttacttatatagccggtaagtccaaggatttgataaatccgatggaaggtcttaatctcggtgaactaccgggacactggatggtgatgaccagggacttatggaaagattttggtaatattacgttgactggtatttcttttatctgcccggagagacgtgatgcgggatttgatgaaatctttctcgctaagacacaggatgatataaagaatgctccgaaagtacttccgagcgaaattgcaactccggtacccgttgatggagaagaggaagggctggtatatgaagagggaacaactaatgaggatgaacaaccgcaaggggtacagattgactgggctgcacagattaaagcgggaggattcatgatgtatccgttgtatttgcttggattgcttgccttagtaatagctttgcaacgcttgctaacttcaagagaaggaagactggcaccaaaaggactgcgtaaaacagtcagcgaatgccttgcacaaggagatttgaaaggtgcgattgcagcctgtgataaatacccttccacattaggaaattcgctgcgttttattttcgagcatgtgaaagccggaagagaagctgtcagtcagacagctggtgatatggccgcacgtgatatccgtacacatttgtcacgcatatatcctttgtcagtcatagcttccctgtcgccccttatcggtttgctgggaacagttgtcggtatgatcgaagcgtttggtctggtagcattgtatggtgacgaaggcggtgcttctatattgtccgattctatttcaaaagctttgattacgactgctgccggtttgatcatcgcagctcctgccattgctttgtatttcattattaaaaatcgtattatgaaattggcttctttggtggaagtagaagttgaaaatgtaattactacgctctatctggaaggagattcgacggatatgaacacaccggggagtaaggaggagaagcatgagactaaactatgatgaagaagacaaagtagaggtgcagatgtcgcccttgatagactgcgtctttctgctactgatcttcttccttgtgactactatgatgaagaagtgggaaatgcaaatacctttatcacttccttcaatgacttccagcttgtctaccacccgcgccggagaggaagctgttatcatagcagtggatgaggagaaaaatgtgtatcaggtagtaggacatgatgcgtacactggtgagaaccactatgtaccgatttctgatctgaatactttccttacagaactccgcaacagtgaaggtacggaaattgctattgatgtggcggcttaccggactgtacccgtaaatacggtaatagagatattcgatcaatgtcaaatacaaggattcacgcgtacgcgtgtccgtttgggtagtaaaccttattaagcttatgagactatcactatttaataacgaagatgaaccggaagtgtctatgtcgcccttgatcgactgtgtgtttctgctattgatcttctttcttgtctctacaatgacgaaggtgaaaaacagggatatttcagtggatctgccgacttcggaatcagctataaaactgaaaccggatgataaacaggctattgtaggactggatgctgaaggtaacttctattgggacggacaaccttgttcgactaattttatgatggaacaattgcgggagacctgtatctctgatccgggtcggcgtatccgcattgatatggataaaaacactccattcggacgttttgtggaagtaatggatgcttgtcagttttataatttaacgaatataggaatacgaacatatgacgaaaactacaacagggagtagccgtctgacggttatcctatcatgggttattgcgctggtctgcctggtaggaggagcgttgtttatctggctgatgccatcaccaggacagggagctattgacttgcaagcgaaaaaacagaaatctccgaaaagtatcagtgataaaataaagcaggagcaggctcagcgggagcttcccgctaattattctgagcaattagtgaagcagtcggaagtattggtcaagaaaaatttggaagatcagcttcgtaaatttcaggaaatggctaagaagatgaggcagcggaaaaatgaattgttgactaaagtagagcaaagaaagttaccacgtacggcaccggatgatgctaatgatacttcgaaagcaaggaatattccgcaggcgggcaagttatctgcgaatccgtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggttcttcccgtatgccaagttttgatgaactgattcgaatgcagactaaagggggggaatgggctacttcagcgggaagtaatgccagcgcaggtctggaaataaaaagtacggcagacttgaacaattaccgtggtctgttgggacaagcgacccgacaagccggacttgctcaatctcggttggaaaatctctttggagtagtgaagcaggtcggaaagcccggtggcggctttggaattggcaatggtcagccgggcggaggtgaaggcagtggcaatgggaacggtttcggtggcatgggggaggcagctcagggcagtggaaacagacgtccgatgaatgcttatgcaggtccccggcttaatcaggaaatggtaaaagctcaggcattgcccggacggcgtttctcaaaaagcgcggatcgtaaagggtggttatatattaacacatggtatatgataggaccgtgggaaagttttgggcgagaggacttttcgattgtccatccgcctgagatatctgtggactttgatgcggtatatactgacggacaagtaggtacaggggtgatggaaacggattctcatccgataaaggtcataggggaagaagtgtatttggatggtacgctgcgatggaagtttatgcaaagtgaatcaatgcataatacggttcctgtcactaccggacattctacttattatgcttatacggaactttattttgatgaggctactaccatgctggttgccatcggtacggatgatagtggccgggtatggataaatggtaaggatgtatggcgcgattatggtaccagttggtataatattgacgaacatattactcctttccagttccgtcaagggtggaaccgtattcttgtgcgattggaaaatggcggaggaggagcgtgtggtttcagtttcttaattattccacaagagtaagatgacacacgttggccggcttatagaagatgaactacatcgacaaggattgtctgtcacttggtttgcagaacagctttgttgcgcgcggaccaatgtgtataaaattttcaggaaatcaagtattgataccgaactccttttgcgaatttctgatatcttgcaatatgacttttttcaatgttactcagcgtgtttaaagaacaaaaaggaaatgatgtagttgtggatacatcatttccttctcttttataattttagttttgtaccgattgtcgttttcttttttgtccgaaggtattgaaccgatacgcaatatatgccataaaatatacgttagaagtactggattctctgtcggtgatagaattctcggaaatggaacgttccgaactttcattctcacgaagtatatcatataggtgaaatcggacggttgcctttttcttcttgaggaagcttttcgatatttgtgcgttccatagggtgcggttagtatcatttttaccgccatatcctctttttaatctacaattgatattggatgagatttttatatcccaaggtaagtttaagtttgcttcagttccgaatgtataatcaaatgtttcccgtcggttctcttttttgatagaatgttctgattttcgatatctgacttctgcagataactcaaagtcaatcagatcgctacggtagctcccttttaagcgttctgataaaaagaggttagtcgtattacttttaactgcatctgactctttgttgagcacagtgaaaccgacagagttgccgtaatttgtattggtgtgtgtatttactgtgaattttttgttggataatggagtactgaaggtaagcgaaccgtttattcgccagttcccgttcacattagtcggttgggtagtctgtcctccggtattttcgtcatatgtgacaatacgtgttgtactattcattgtattattataggagaggttagcattcaaactacgggatgtttcagtaaagtaagtattaaatgtagctgatatgttgttattgaatgatggtttaagttcggggttagctagccgtatgtttaaaggatcagaaatatctttttttctatataagtcggtcataccgggttgtgccgttctcccacgatagtttatttttaaggttgtttgtttagagaaggtatacttaaagtttatggtgggggagtagtttattgcatttctggataaatactcaaaggtcgtgtcccgcatatagcttttatttgtcgttttttgtgcctcaacttctatacctatattataaaaatagttggtgcggatagtacggaaaaatatgccggtttggtgggtggaatatttatttttgtagcaatcactgtgcgctgtgtcaggatattgactgtatgtatcttcttgtttatcccagtcataggcatatttttcagagagtgaggaacggtgttgatagctataattaatttcgataaaccgattggtaaatacaggttccatatatgttatctgaacttgatatttattgtttttgtcaagtttttcaatccattggttcaaagtttttatactatcaccatacttcaagtaataagtattcgaaagactataccgatcggaattgccgtcatccagatcgtaataaagacgtaaggcgatgtttcttcctttgctgtttaatttgcggttcaactgcaaagagccattggtggagaatctgtcattcgtttggtggtttgtggcttctttccggttgataggagttgactcgttgttgagcgtttctgagaagttgcctgaattggagtttcctttggaaaaattaaatgtcggtcgatacataatagtggtgaggctgtctaatttccattcgaaacgaaaattagcggaaatagcacttgtctttccatcggattggttgttctgcagggaaaactgagaagtgttgtctgacaaaaaagattctgtatgacgcttgctccatgaatcgcgtttattttcccggacttcaatactacctccatatttgagtttctgagtattctgagaatagttggcacctattctttgattggaattaattccattgtcgttggcggtaccattgattgataagttcattttgtttttgaaacgattggccattccttttgccctataatggtcgtcatttccatatcctgcttcaaagttaccattccatccttttctcatacttggttttacgcgtaagtcgagtaccatttcttctttaccgtcatctactccggtaatacgtgccatgtctgatttcttttggtaagtttttagttgatctatcatatcggctggcagttcttttaaaaccgtattggggtcgttaaggaagaattcttctccgttcatcatgatttttttgacttcctgaccattaatgattaatttcccttcttcgtttatttcggctccgggtagctttttgactagttcttccaatgcagcaccttcactgacgcggtaagcggaagtattatatgcggttgtatcacctgtgacgacaacaggcggggcttgggctacaatgacggtttcgttaagaagtacagcatcaggtttcaactctattttgcctagttgaacaatagtctgggttgtgtttatttgcaggggcttatattcggtagcgaggcctatgaaagaaatttttagcaaaaaacgtcccgggagagttgtgagtgaaaattttccctgttccaagctggaaatgccttttacataattactgtcgggcaaggataacagttgtatggtagcttgctcaacagggaactgtgtgtctttttccagaatactcccctgtactgtgacacgttgagtctgtgcttgaatataagcagtatttatgtatgatataattaatgttattagtagtataaaagtcgttttattcataaggtctcccgttatgaggtgttttagtgtttatggtatttcttgcaaatatcttgattttttctgtaaaaagagttcataaaatgataaataaagttcatttgaacgatattcatacccttttgacttatttgaggacctttgtttacgcataatacctcatctttgcaccgtactcagttttcaataggtattattttagtttttaggaacacttggattattttcaaattcgctgtcggtttaatggaaacgctctacttgcatatgctgtaaacatatatacaggaaaacataaagaagtgacgagaaatatcttaagaagttttctatgtgtttttatgacaagtaaaccgtaagcggcaatcaaaataacaacattgcgtgcgcccatatatagacgacataatatgttaaaaaaataatttggaaattgtacaatctcagattcatcatatgtatcattacgataatcaccaatatttgaagaaagtattgcttttaaaaatgaaggaaataaaataatatataacactatctgaataaaaagaagtatccaaaccaaatttatgaagaagttagaatttaacgtttcaattcgagtgattctagtattatcatatctgataataggatatgcaaaaagaaaaataacaggtataagatataaaaatggtataattgaatacgtctccctcccccgcatataatgaaacaactcgtgctcatgatacagtaatgctccccatgcacaaatcgaataatatgccaatatatagaaagcgatatttaacttcctatttttccaatagtggtaaactgctaatatagaaaagacagcagcgttaaatatcaatatttgtaattctgacatttatttgattttttgttcacccataaatagcttggctattattggagttttcttaatactcttttaataatttgtttcactatttttttagtgataacatatttgctatcaccaaaatacttcttatatgcagcatcaaaccctcttaaaagataaaattcccaaaactcttgtcgtctttgattagaacatgtagggcgaattaagcatggctgcatagcttcatctttcgttatcttccacaaatcaatagaatcgtaaagtttgtttatcaagtctaaccccatattagtattcaccattaataatgaagtaccttcacatgaatacaaatccgggcgattcttcttgtcgtcccaaaaatcagctattgtaaaatctccaggacggtccaagttagaatatttacaagagtgacaagaaggacgatttatcatttgagaaaaaaatatttttccccaattaactacccaaacaggatcgacagctttctggccgttttcaaaataaaaacaataagagaagcgatgactccacccataagtttgtttgtacctcatgttgatagacatgaccttttggccaagtttcgtcgaacacatatttatatattgcttatatataagtggactaggaacagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacttgacaaggagaacctgtaaacaaaacccagcgatcgctttttaaataagtctttatctgattgtaaacaccttgaatttcactctggacatattttgaccccataaaactccttataccttccatcgtttccgaaaagctatgtctcactactccatcgttatcatattctacaccacaaacaacccctcccaattctattacagatcctgcaatagctgtaaaagcaccaccactagaactgttccgtaacgttacaatatttttatggcgagctgcaaaatatgcttttggagttggccttatatccttcacctttctataaagaataggacaagccatctcacaaagtccacaattgatgcatttaccttcctcaatcataggatatttaaaaccttccacatcttccttaaaaactatcgcattatgattgcagattgacaagcatgcagaacatccacaacaatcctctgatttttttatttttatcatgatcctcaacagcttatttgatatgattacaagttattttttataagcttacgcacttgatcaacgacaaatactctttcacttgctttgcaacccacaaaaaagatagccataaatgagcatatgatacatgagaaagataagatcaagaacgaataaaatgatgattgtaatcgtaatgagattaaatagggaattgcaactgaaaatatcgtcacagcacatatattaaagaaaacattcttcatatagcttctaacaggcaattgtatcatactacgaagcataaataaacgaagtgccaaacaacataatgatataccaatagccacataaagagtaatttctggtgcataacctcgttctaacaatatatatgaaataggaaaattcatcatttgcataccgcctacaactatttggtaatttctaatactgcctgttgccagcatcgcagtaatcaaaggatttgatattgattcacacatggcaaagatcaagactaaacggacaaatatgattgtataatcaggaacaatttttaaccatattgataatatatattctgtactcatgagtactggtaatgacaaaaatagtaacatataaaaagataatcttgccccctgaaaaatcaaagtaaacatgtatttactatcacctacagcaaatgattttgttatctgtggatttaatgctgtcataaagttttgagcgaaactattaattgcatgattaacctgtacagccatccctcttgcagcattgacagttggaccacaaaaaagatttatagcaatatttacgccttgatctctaaggattgctgaagatgcccctataaaattccaacccgaaaagctcaacattcttttcaataggaatctatcgattcgacaaaaacatttacattccttaaaatgtcgcctacaatatataaaataagcaaaggttataacaattgctaccaccaacaacaaagccccataaacaatcaatttatctactgacattaatactaataaataaacaattaagagtttaagtgacacctccagaatactaacataagcaaatgcagacattcgttcgtgtgcaataattaaagcattaaagggaatacaaatcaaattgactccaaaggtaaaaattgagaactgaagcacccaatttgccgcattcatacgaacttcgggtatattcattttattattaagaaaccacactcctataagctcagcaagtataacgaccactaaagccattaaaaactgtataactactgctgtagaaaataccgtcttcagtcttcgtagatcacctttgcccaactcaatagttataaagcgactaatggcagaagacaatgaggtagatataatagcaaacatagttactactccccctaccacattataaataccaaaatcttcaacccccaacgtagctagtaccacacggctagtatacaatgataccatcatggtaaataacatacggaaatagagaagaaaagtattcttagctattcgcttattattgtaattagtagatacagataagcccatataaataaaacagatctgcaagttaattgtatcttggctaactatatttttaacatattgtcattgcatatacttcgatagagatctatgaatgtctaaataaaagcgggcaaatatgtgataaataacatatttgcccgctttctataaaaaataagattcgtatcttacttaccggtaatcgaatttttcttcccctgcttatttacaactgaagggcttcctttatattcaatatcaccactaccactaactctcgcatccaactgtctggaagcgtagcatactatatcacccgaacctgcaactgtagcaacgacattagttgcagccagtttttcagcactaatatctccggaaccatttactgtcagtgtcgccttctgtgcagaacctttaatattgatatcaccggaaccattaacttctgacatcacagtagtcgctttcacatttttcaaatcaatgtccccgcttcctttcaccaaagcaaatatattagtatattgcagattctccgcttcgatatctccggaaccggctatattcaaattcaggtcattccctttgattgcacctttcagatatacatctgccgaacctttaatatttacctgattcaatgaaggggaagaggctatcactttcaaacgacgctctccactaagaatcttgacaccctttttgatattcacctgcaatactccatttactgtagaaacttccagcaagtctaccaaattatccgaaccgtatatagaaactgtcgttttagaaccattactctgacgatactcaacatcaggactgcctaatacgctgattgagctgaagttgcttacgttattcagttcttttgtgatatatttcttactgggagtaacggtctgcgcctgtattcctgtgaccaacagaaacattagcactaccaacatagatgtaacctttgaatttctcataatttcttttcattaaatattttaatgacaaatataggaagtatatttcgaattacaagaaaagaattacaattttgccaaccattctccaagttcctgaagccactcctgcttatacacaaaactatcattataaccgaatccatgtcctcccgcaggatagatgtgcagagaaatggggatatctgctttctgtagtctggcagcatacataataccattcagagggcttaccacagcatcatctgcagctgctacaatgaaagcggcaggtgtgccggaagtaatatgctcaatcggtgaatactgctccatcttatccggtgaataggaatgaccaaacattcgttcacgacaaggaaaatgtgtcaaacgatcatcgacactgactaccggatacatcaatatctgaaaatccggcttctcatcatcaggcaaaagcgtagctgaaaaagttgccagatatcctccgatagaagcccccatcactcccagtttatcacaaaactccggaaacttttctcgcacaaccttcaatgccaaccgggtatcttgttcgggaacatcaggattaccatgaggcattctatatttaaagacgatatatgtaattcccagcttcgtaaaccattcggcaaaatcaataccttcattctccagattagtcttcagaaatccacctccgggacacataataacactgcttccattgggcctgtcacaagtaaaaacaaataaagttccttcggaagcattttctacgattccaatcagttcggcattgtccactttcgacaaatcataggtcgtcatggataagtcctcatacaagctaatacaaattaatttcttcatatcgattaatgtttaagtttcttccctattttatgaacaacagaaggaccggaataaataaatgccgaataaatctgtaccatatcggccccttgggaaatcatatcggctgcatcctctgctgtcattattcctcctgccccgataatcagaaagtggcggtcggtgtgctcggacagataatgcactaccttctgcgatttctttccgataccccgaccactgacgccaccgttaccgatcttttccaactgttttgtttttgtctgatgcaattctgagcggtccatcgtcggacccgtggctataaagccttctatggaatatttatatgcaagggaaatgaccagatccaattccttctcatcaatatccgccgggagcttaatgaaaatactgcaccgtttgttcactgcctcacggaatgttgtgaagttttctaaaactttagcaaatgattctttatctatactaccccagttcaacgtaaaataatctacactttcatataaacgagtgaaaaccagctcaaaatctttgatgatctgctcaccgacagaaagcggattcttattgatatttactccgagtatgtaagaatgttttctgtgtcttctgatatgcgccagagctacatcgacaccgcaattattgaaccctgtacgtgagatcagtgattcgtcttctaccagcctgaagatacgggaagaaggatttcccggttgataatcaggagttacagtccccacttccagaaatccgaaaccaaaatctgccaactcatcaaatgtttccgcatttttatcgaatccggcagacaagcctatccggtttttgaatcgcagacttccgtatgaaaaaggttcgtccacttgatagtgtcctcttacgcatgcacgaaccggaagcagatagcgatagattcttaaccagttcaagagcatccgatgtactttttcaggatcaatgagaaataataacggtctaacgattaaattatacattttcaattatctgttttttagattaaagatatgaatccacactcaggaaataacttcttcctagtgctcttacgtatgcaaagtaagacctttttgagcagatattgaagttcattttttttatacccgataacttttgattatccctgcttcttattgcctgtatattgggtacaaaattcctttttaatcgtcctcctataaaagtataaaagcgattagatgaaaatgaataaaaagagattaatcggatatctgtttgtaatggtctctgcaggatgtattcatgcgcaggagaaaaaagtatctgcacaggaatataagctatggtatgaccgtcccgcacaggtatggaccgaagctttacccttgggaaacgggcgtctgggggcaatggtatatggaacgccgggaacagaacaaatacaactaaacgaagaaaccatttgggcaggacgccccaacaacaacgcaaacccgaacgcactggagtatattccgaaggtacgtgaacttgtttttgccggaaaatatctggaagcacaaacgctcgctacggagaaagtgatggcaaaaacaaattcgggaatgccttatcagagtttcggcgacctgagaattgctttccccggacatacccgctattccgattattatcgggacctgagtctggactcggcacgtgccatcgtccgttatgaagtagacggagtgcaatatcaacgtgaaacgatcacctcatttaccgatcaggtagttatggtacgactgaccgccaaccgtccgggacaaattaccttcaacgcacagctcacctcccctcatcaggatgtaatgattcactctgaagaagggaactgtgtgaccctttcaggggtgtcttccttgcatgaaggactgaagggaaaagtagaatttcagggaaggctgaccgcccgcaaccaaggaggaaaaatagcttgtaccgatggcgtcctctctgtagaaggagctgacgaagccacaatctatgtgtctatagccactaacttcaataattatctggacatcacaggcaatcagacagaacgtgcaaagagctatttgtccgaagcgctggttcgtccattcgcagaagccaaaaagaatcacgtagaattttatcgtcgatatctgaccagagtatctctggatttaggggaagaccaatataaaaatgtgacaaccgacaaacgtgtagagaattttaaggacacacatgatgcgcatctggttgccacttacttccagttcggccgttatctgttaatctgctcgtcacaaccgggcgggcaacccgctaacttgcagggtatctggaatgataaacttttcccttcctgggatagcaaatatacctgtaatatcaatctggaaatgaattactggccatcggaagtgactaatttaagtgacttgaacgaaccacttttccggctgataaaagaagtgagcgaaagcggaaaggaaacggcaaaaatcatgtatggagccaacggatgggtattgcatcataacacggatatatggcgtatcacaggagcactggacaaagccccttcgggtatgtggccgagcggcggtgcatggttatgccgtcatctatgggaacgatatctgtacaccggagacacagagttcctgcgttccgtttatccgatattgaaagaatccggactgttctttgacgagattatggtgaaagaacctgtacacaactggttggtagtctgcccaagcaactcacccgaaaatgtacattccggcagcgacggcaaggcaactacagccgccggatgcacgatggacaatcagttgatattcgacctttggacagctattatttcagcttcccgaattttggatacggacaaagaatttgccgctcatctggaacaacgcctcaaagaaatggctcctatgcaagtaggacattggggacaattgcaggaatggatgttcgactgggatgatccgaacgatgtacaccgccatgtatcccatctatatggattattccccagcaaccagatttctccttaccgcactccggaactatttgacgctgcacgcacttctctgattcaccgtggagatccgtccaccggatggagcatgggatggaaggtttgcctgtgggcacgcctccttgatggtgaccatgcctacaaactgataaccgaccaattgactctggtacgtaacgaaaagaaaaaaggaggtacctaccctaacctgttcgatgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggtatcatcgcccgtggaggtttcgaacttgatttaaactggaagaatggaaaagtaaatcgcctggtcgtgaaatctcataaaggtggtaactgccgtctgcgttcactcaacccgctgaacggaaagggcttgaaacgtgccaaaggagagaacccgaaccctctctatgcagtccccacgattccccagccattggtgaatgaaaaagccagcctaaataaagtggaaattgcaaagacttacttgtatgacctgcctaccaaagcagggcaagaatatatattgattggaaaataataactctacctatatgaacagaaacttgttaaaactgattgttgcttgcggagctgcttgcttcatcgcctgcacagcacctcaaaaagcagaaacagaaaaatggagcgaacgtatggcacgctctgagatgaaacgttttcccgaaccctggatgattgaaaaagcaaaagtaccccgttggggatatacccacggacttgttgtaaagtctatgctggaagaatggaaacataccggagacagcacttactatgaatatgccaaaatctacgcagacagtctgatcgatacggacggccatatcaaaacgatgaaatatctttcattcaacattgataacgtcaatggcggcaagattctttttgatctttatgcacaatcaggagatgaacgctataaaatagctatggataccctacgtaaacagatggcagaacaaccccgcacaagtgaaggaggattctggcataagctaagatatccccatcagatgtggctggatggcatcttcatggcttctccttacttggtacagtacggcagtactttccaggaaccggcactatacgatgaagctgtgaaacagattcttctgatagcacgcaaaacttacgaccccaccacaggactttactatcacggatgggatgaaagccgcgaacagaaatgggcaaatcccgaaaccggttgttctcctaatttctggagccgcagtatcggatggtatggagcagccttggtagacgtactggattatctccctcaggaaacgaccggacgagacagcgtaatgcagattcttcagggattggcaaaaactttaatgaaatatcaggaccctcagtccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctacccgcaaagcttttgatggaatggtcaagacatttacccgtcttgaagaagacggtagctataccattacgaattgttgtgcggtagccggactgggcggagactccaaaagataccgtgacggttcattcgaatattatatcagcgaaccggttatagagaatgacccgaaatcagtaggatcgtttattctggcggccatcgaatatgagaaaatgacagacaaataaatgtaaagatatgaactccaaaaacgataaagtacaatgagaaaatttaagattcttcctctcttattgctgctgttgacattggcaacttctgccgcagcacaaaagaaaacacaaaagacgtatatcccatggagcaacggcaaactcgtcgtttctgaagaaggacgttatctgaaacacgaaaacggcactcctttcttctggctgggagaaaccggctggctgctgcctgagcgtctgaatcgtgacgaagccgaatattatttggaacaatgcaaacgccgcggatataacgtgattcaggttcagacattgaataatgtcccgtctatgaatatctacggacagtattccatgactgacggctacaacttcaagaatatcaatcagaaaggcgtatatggttattgggatcacatggattacattatccgtaccgcagcaaagaaaggtctttatatcggcatggtctgcatctggggaagtccggtaagtcatggcgaaatgaatgtagatcaggcaaaagcatacggcaagttcctggcagaacgctataaagacgaacctaacattatctggtttatcggtggggatatccgtggtgatgtgaagactgccgaatgggaagcattggcaacctccatcaaagcaatcgacaagaaccatctgatgacattccacccgcgtggcagaacgacttctgctacttggttcaacaatgcaccgtggctggatttcaatatgttccagagcggacaccgccgttatggacaacgtttcggtgacggagattatcccatcgaagaaaatacggaagaagataactggcgttttgtagaacgcagtatggctatgaaaccgatgaagcccgttatagacggtgaacccatctacgaagaaataccgcacggtctgcatgatgagaacgaattactttggaaagattatgatgtacgccggtacgcttactggtctgtatttgccggttctttcggacatacgtatggtcataactccatcatgcagtttatcaaaccgggtgtaggcggtgcttatggtgctaaaaagccttggtatgatgctctgaatgatcccggatacaatcaaatgaaatatctgaagaatctgatgctgaccttcccattcttcgaacgagtaccggatcagtctgtcatcgccggacagaatggcgaacgttatgaccgtgccatcgcaacacgcggcaatgactatctgatggtatataactacaccggacgcccgatggaagttgatttcagcaaaatcagcggtgccaagaagaacgcatggtggtacacaaccaaggatggtaaactggaatatatcggtgaatttgacaacggtgtgcacaaattccagcacgacagcggctacagcagcggaaacgatcatgtcttgattgtagtagacagtagtaaggattatgtgaagaaagactgctatcaaattgacactcatgaataaaaagatacttatattatcattcttatctgttctgtttcttgcagcaggtccgatacgtgcagccatagacgtaaccaacctgcggacagagcagctaaagaatccgtcgggtatcgatacgcgccaaccccgtctgggttggcgtatcgaatcggacgaacagaatgtgatgcaaaccgcgtatcacattcttgttgcatcttcccccgagctattggcacaagggaaaggagatatgtgggattccggaaaagtagaaacagatgcttcccaatggataacctaccagggagaaactttgaaacgcaatgctccctacttctggaaggtgaaggtttacaccaataaaggtgaaagtgattggagtagtccggctttctggagcatgggactattcaatgaagcagactggcaaggtcagtggatcggtctggaccgtgcagctccgggggacagtgaaactcaatggagccgcctggcagcccgttatcttcgcaaggaatttgccttgaagaaagaaataaagcgtgccacagtgcacattgccggaatgggattgtatgaactgttcatcaacggacaacgcataggtgatcaggtactggcccccgctcctaccgattaccggaagacaatcttgtataacacatatgatgtcacttcccaacttcagcaagagaacgccatcggtgttactttaggtaatggtcgtttttataccatgcgtcagaattacaagccatacaagattccgaccttcggatatcccaaactgcgcctgaatctgatcgttgaatatgctgatggcagtaaggagacaatcgcgacgaatacttcatggaaactgacaaccgaaggtcctgtccgcagcaataacgaatatgacggcgaagaatatgacgcccgcaaagaactgggaaactggacgcagacagattatgacgatacaaaatggatgccggcagaacgcgtcagtattccttcgggtacacttcgtgcccaaatgatgccggggatgaaagtaacggaaacgctgaaacctgtttctatccaaaaaatgggtgacaaatacattatggataccggtcagaatctggcaggatgggtacgtttccgcatcaaaggtcaggcaggcgacagcattcgtcttcattttgcagaacgtctggaatcagatggagaaatcttcacgaaaaatctgcgcgacgcacattgtacggatatatatgtagttagcggacgtgaaccgcaaggtgccacctgggctccccgttttgtgtatcatggtttccgttatgtggaaatcagcggatatccggatgccaaaaccgaggatttcgtagtggaagtcgtagaagatgagatggatcatacaggctctttttcctgttcggacaaaacattgaaccaagttgtacgtaatgcattctgggggattcggagtaactataaaggtatgccggtagactgtccccagcgtaacgaacgtcagccctggctgggagatcatgcaatgggctcttggggagaaagtatgttcttcgacaatcatgccatgtacaacaaatgggcacgtgatatccgcgaagcacagcgcgaagacggctgtattcctgatgtagctccggcttactggaactattattcggataatgtcacatggcctgctaccctgcccttagtctgcgatatgctcttcactaattatggagacatacgtccgatagaagataattatccggctatcaagaaatggatatcgcacatccgtgagtattatatgacaaaggactacatcatcaccaaagataaatatggagactggtgtgttccacccgaatcgttggaaatgattcacagtcaagatcctgcccgcaaaacggatggtgccttgatcgctaccgcctattacctgaaagtgttgcaactgatgcatcgcttcgccagtcttcagggattgactgcggatgcaaaagagtgggaagacctggaacataaaatgaaggatgcattcaatgcacatttcctgcatataaaggaaggtacttcacttgtacccggtcatactctgtatccggatagtgttttctacgggaataatactgtaacagctaatattctgccacttgccttcggtctcgtgcccaaagcacatatcaaagaagtagcaaagaatgcagtaaccaccattattacaacgaacaaagggcatatcagtaccggagtaatcggtacgcaatggctgatgcgtgaattgagtcgtcgggggcatacagatgtagcttatctgttggctaccaatgatacatatccttcatggggatatatggcagcacaaggtgccaccactatttgggaactttggaacggtgacacggcaaatcccggaatgaacagcggaaatcatgttatgttattaggagacttactcccctggtgtttcaacaatctggcaggtatccgtgccgaccgttggaaatccggttacaaacatattgttttccagcctgctttcgaaattcaggaattgagtaacgtggatgcttcttatatgagtatctacggaaagattaccagccgatggaaaaagactcctatgcatctggaatgggatatcgaacttcctgccaatactacaggagaagtacatctgccggatggacgaaaagaaaaaataggttccggaaaatatcatttcagcgtagatataccgacacggaatgctgccatcatcagcgatgaatttctatatgagaaagcttctttcccggaatgccacggggcgaccattgtagaactgaaaaacggtgacctcgttgcttctttcttcggtggaaccaaagaacgtaatccggattgctgcatctgggtttgccgcaagcccaaaggtgccaaagaatggacggctcccaagctggctgccgacggagttttttcactcaaagattcgcaggctgctttagccggcatagattcgacctgcactcctgtagtggatgccaaaggaaaactgactgcccgccggaaagcttgctggaatcctgtacttttccagataccgggaggagatttgattctgttctacaaaataggactaaatgtaggcgactggaccggctggctggttcgttcaaaagacggtgggaaaacttggggcaaacgcgaagccttgccggaaggatttctaggtcctatcaagaacaaaccggaatacatcaacggtcgcatcatctgcccgtcaagcagagagggcaaagggggatggcgcattcattttgaatattcggatgataaaggcaaaacctggaaaacgacagagtcggtacctgccgaactgtctgtcccgactcagaaccgtaaaaaaggtggtattaacgtagatgatcaggaagcgggagaagctattcagggagaaggggcacaaccgattcttgccatccaacccagtatcctaaagcataaggatggaagattgcaggtactttgccgtacacgcaatgcaaagattgcaacatcatggagcagtgacaatggtgaaacatggagtaaagtgacattaagcaatgttccgaacaacaattccggaacagatgccgtgacaatgagtgacggacgtcacattctcatttacaatcatttctccacattgccaggcacaccgaaaggtccccgtactcctctctgcatagccatatcagaagatggaatcaactggaaacctattctcacattagaagacagccctatcagccaatattcttatccaagcattattcagggaaaagatggaaagttacatgcaatctatacctggcgtcgccaacggatcaagtatacggagatagatctctcaaagtttaagtagtagctgaataaaagaaaaacagattctctgttatcattataccgcactgacaattatcgtatcagtgcggtatttcaatcaaaaagcaagacacgcacggacgcaatgtttactgttcttataatcccaatccatggcgccgacgtaggtgtcggcatagtatgcgttgagaaacggatcgtagtcgtcctccgaactcgaccaataccccaatttccacccatagtcattatccccggtagctttattgacagcggataaaagataagctttattgtacatccaataccagcattgacctagcgagggtaaaaaccaaccactgctgtttgcaggagcgggatggctatactcataatccgttacccaatagacagggggaaatccattctttaaagttcgattctcgttttccgcaaacgagatgatcccctgtgtattcttatagccatagaaaccggtgctcggctcacctctgtttatatcagttaggctccaaagcccccatgtacaagcatttcctccattggcatcataaagcgcaagaacgtaaccatgtacggtatgcatctctgttataccatatttctgtttatatttacagtagtctacccattcgccttcactgtctttacctgacttcaaaacgatacccaagcagttcatatctgcggaaagagcagtaacatcaccgggaatcaaatagccgttattactttcatccttgcaataaaaatcgcccatttgagctttatccaatgtataatcacctatatcttttaaaaccggagtgaatgtataacaggtattagcagataaatctgtatcaggcatcgcaccactatacatctctttgttatattcataaagccaacgaacctttgcccttttcggagaaataattatttggtaactgccatcattcatttggtaagggaaaagaggctctgttccgacattgaaactcacatcactaatcgaagaaggaacataagtaaagtctctccttccattaattttgcattttatggaaggagacaacgaaagtaaggaataagcatgttcaaatactatatccaatttctttaacggtctaccactcgtgtcactccataccaacaaatcggaagcacggtaggcatctttgctgcgttggtcaccctgcggtaagaatttaccttttagatcatctatgttaatcacgttatccacttccttactatacggaaagtaggcaaggtaaacggtggctttattgtcgtagtaaatggttgtttttccttcatcgttattgctgtcgaagctccaaatgttaccatcatatcgataaggtatgttgtcggatagtacattattatctgcatccagcacaatgatgccgatacgatcaccattttcgaaagtacccgtacttccgctatccgtagcacgaatactggaaacatcgttgatagcaaagtcaccaacacgaacgttcagttgcaatacttcaccgtcttgctgcaccatacccgaatctattttttcatcaccattgcaagccatgaaggataataacgagagcaacaacaaatacttcaaattctttttcatactcatttttctatatattattaaaaagtcaagatgacacggatagaattcttatccgatacgctctttgcatggtcattataaagagcatttcctactaatatgaaattcctctcgatactaaaaagctagaactgtttttaagacgtttaccattattcatagccactaatggtttaacatttttcaacactatatacaagtaaaagcccaaagacttatattttaattacttgtcaatagaaatctttggataatatttataaaaggaacagattattataaggtgtatttcctctaattattctttttgtttaaagaaaaaaaactacttattttcttgttatttaaaataaattcatatttttgtaatcgtagtcagaaccaaactatgaaatattgacgtcctctctacacacagacaatttttattaaccttaaaagagcagtattatgtttaaaccactcaaatcagtaagtgtgctgttgctcttgtttgccatgccggcagcaatttcctatgcagcctctgagaatggagcaacaagtgtgagtgtcacacagcaaaacggtacgtgtaaaggtgtagtaaaagacaaggcaggtgaagcggttattggagcttcagttgtagtcaagggtactacaaatggtgtaattaccgacttggacggtaattttgttctttccaatgttcctgatggagcaacgattcaaatctcttatgtaggttataccccacaggaagtgaagttcacgggtaaacctttagacattaccttacaggaagatacgcagacactcgatgaagttgtagtgacagctttggggattaagcgtcagaaaaggtccctcggctattctacaacgacagtaggaggaaaagatttcacggaagctcgtacaacgaacattggtaacgcactttccggtaagattgccggtgtttccgtttccggaaatgcaacaggtccgggtggtagtagccgtgtcgtaattcgtggtaatgcttctttgacgggaaacaaccagccgctttatgttatcgacggtgttccgtttgataatactaatattggtagtgcaggtcaatggggaggtaaagatatgggcgatggtttgtcaagtatcaatccggatgatattgcagatattcaagtgttgaaaggtgctgctgcatctgctctttatggatatcgtggtggtaacggtgctatcttgattactactaaatccggtcagaaaggaaaaccggtctccgttgaatttaacaataacttggcttttgatgtgatttatgattaccgcgatttccagaatgtctacgggcaaggaactcagggtaaccgtccgctttctgcagatgtggcaaaagcaacggaaacatccagctggggtgaagtaatggatggaaaaaaagcagtaaacttcttggggaacgaatatgcctattctcctgtagataactggaagaacttctatcgtactgggattaacaatacaacaactttggcagtaagtggtgcttccgataagatatcctatcgttttggtgtttccaatatggcggtaaaggggatacttcccaattccagcatcagtcagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttatcatgccaattcatttgatatccgttggatggaacgtgaaaatccggattgtgactggggtaccggtgctgacggcaaagagttgttaggcggtacgaacggttatttcaataatccgtattggttgcagtacagggttactaatgaaaccaaccgtaatcgtctgactggtggtatgactttgaagtatgatatctttgactggttatacattcagggtgctgtgacacgtgacggttataatctggaatattccgaagtgaagccaatcggttccgcttctccggaagatccacgcggttatataaaggaatacactcagaacttctctgaaatgaacctgaactatttgatcggattcaataagacattcggagactggagtgtcggtgctactttcggtggaaaccgtcagagaaatattacaaagaaatacggtctggatgataaggcctcttcattctttgtgcccgatttttattcaagtagcaacactgcgaagcatgtgtataagaaagaatatacagaatatcgggtaaattcaatctatggtactgcagaccttggttataagaatcaggtattcttaaatttaaccggacgtaatgactggttctctacactggacccggataataatcattatttctatccttctatcggtatgtcatgggtatttagtgatacattcaagactcctgactggtttactttcggaaaggtgcgtgcatcttatgcagctgcatccaacggaaccaaagcatatcagaatcttcttacctataaagtagataattaccaatcgaacggacagcctgtagtaacgatcaataactcgaccgtacctaacaaaggactgaaaccggttcagatttccgaatgggaaattggtttgaatctctctttcttggataatcgcctgtcattggatgctgcatattatgtaaaaacaaccaaagatgatatcgtgcaggtaaccaccagtggtgcgtccggttttgaatcagctatccagaatgtcggagaaatcagaaataatggtgtggaagtaatggtgaatgccgttcctgttcatacaaaggactttaactggaattctacattcaatatcgcttataacagcagtgatgtgaaatacctgggaatagacggaacgggagaaaagataaagagacttactcttgacggagccaattcacgtgtaggtagtgtttctgttcagaatatcttggggcatccttatggtgaattagtaggttatgaatacaaacgtacttcggatggacaagttatttttgaaaacggtcttcctgtacactcagacgaggtacaggtattaggaaacggcgtttataaggtaaccggtggatggcgcaatgagtttacttacaaaaacataactctttctttcctgattgacttcaaggcaggagctaagatgttctccggaaccaatctgtctctttacagcaacggtctgcacaagaatactttgcagggacgtggtgctgacggtaaaggaacaatggtgggcaatggtgtaatgtctgatggtaaggggggctatgtgaagaataccgtagccgtttctgcacaagactactggcaggctattaccagtcagaatattgctgaagagtttgtttataatgcgagttttataaaactgcgcgaactgtcagtcggatatactttgccgcaggcatggttgaataagcagacacttataaagggggtaaccctttctttagtcggtcgtaacctttggactatattgaagcatacggataatattgatccggaatctgcttataataacggtaatgctcaaggtctggaattgaacggatatcctgccacgagaaatgtgggattcaatgtaaatgttaagttctaacatcttaaatactgtaacaatgaaaaagtttactttatatatattgacggcttttggtctgatgggattagcgacgagctgtaatgactttggggatgtgaataacgaccctatgaacctgaatcccggagtggtggattataaaatggaatttactcaggttgaagcacagatatgtggctccgactgggacgtgtggcgtaatggctgtatctacacagccaacatgatacagcatacggctagtgtagattgggcgtatggagttttctatacatggaacgatcagtatagtggtgcttattggggaggattctattctggtgggcgtgcagctattcgtaatattatagatgtgatgaataattgggaaggaaatcccgcttatgcgaatgaatatcagatgtgccgcattctgaaagcatatatgttccagaatatgactgacctttatggagacgttccttattctgaagcagggcaggggtattctaccaatccgattccgtatcctaaatatgatacacaagaagcaatctataatgatctgctgaaagaactcgatgaagcacaagctgcattaagcacttctgccggtaatacgataggggctgccgacgttatctataacggtgatgctgcgaaatggaagaaatttgcaaactcactgatgctccgggtagccatgcgcctgaccaaagtagctcctgataaagcgaaaacatgggtagctaaagcggtttcgaatggcttgttcgtaagcaacgatgataatgcgatcgtcagacataccaatggttcaccaagcgatgactctgccgaaccttacggaaaagtattttccagtctggatactcaggcgttctatatcagcgaaacatttataaacatccttcaggacgatcctcgtcttcctctgattgctacagtttgtaccagagatcctaaaccgggatggggagatgctgattttgatttaggtgacaacacggctgctaagcagaaaggtatgccggttggttatgatgtgtcaggaggagactgggatttgagtaaagctccaagctatcaggttgattggagaaaagcatattctgttcctaaccgtacagtttatgcacgcccggattcaccctctatgcttgtcactcatgccggtaacttgttattattggctgatgcagtgaaacgtggactctatacaggagatgcagaaaaattttatagagatggagtaactgctgccatgaaacaattctcctattatgaaaaagcctcagctacgattacagatgatgcgataactgcctatctgaatgctaatccattggatgctgatacggaaaaagcgctggaacagattaatacggaatattatatccatacgttctgtaatgagtatgaagcttttgcaaattggcgtcgtactggatatcccaaattaaccccggctcgaaatgcagccagctatcctaacaatgtgacaaatggagagattcctcgtcgtttcatttatccgacaagtgaaataacagctaatcctgttaattacaatgatgccgttaagagacttagcggaggcgataagatgacatcacgcgtatggtgggataagtaataaagtgttataaataagtcggtcggctcttggggactgaccggcttattatatagtttttaggtctaaataaaagaacgggattcatacgaatcccgttctttatatttatataatctgcaagattgtctttaagtgcaatcttcttatctgtacaatggaacattgccatcaataataccgcctccgaatttttttgataatctgacagaaagtgtgcttccggcttttaaatcaagatcttccactgcactgatcttctgagtgactcctccgacagtgattgttcctatttcctctccagcattgatcttttgcgggagaacattggtagtaacgccttcggatactttctttacttcgatattctctgacagcgcattttcgttgatttctatggtaccgttcaataaatcctgcgtaccttcgtttttcaggctgagctcaactttagcttcgccttcatacggacgatcgttctcatcaagtataataaccggcacggtcattcgtttgaatttcagcgatacattctggctgcccggagctgcttccgctgttccgaacaagtgctcctgacctccttttaaatagcgtttgttaccgcctgatctggtagcggcttcgtctgtcaatgccggatagtgggcgtagaaggttactgtgcctgtggcagttcctatttcgttccatgcgcggctgtctttgccaacaataaacggagtatagtcctgaccggaggcagccatggagataacttctcctgtagtgatgctatttctggcagggaacagatcattgctggtacgggtgagcgggtcagagagagcgtcgtcgatagagatagagaagttggttgcttctttacttgtttcttgcagttcatcctgttgctgacaactgaacaaacatcctgcggctagaagaatcaaaaagttttttcttttcattttactaagtattagtgagtttaagtgagattagatgctaatattctactttgtcttctttggacatccaggcttcaaaggctgtaatggcttcgttgtgcaataatacttccgagggaagttttctgtcggcaggttttagagccagctcatcataaataaaggaatcgtcaaaaccgatgtttttggcatctgtcttgttgttcccataatacattttgtccagtcgtgcccaatagatggcacccagacacatcgggcaaggttcgcatgaagtatagatttcgtatccgctgaggttgaatgttcccagtttcgcggctgcggcacgtatggcactaacttcggcatgagcagtgggatcacatgaagaggttactctgttgactcctgtagctataatttctccttcttttgttgcaatgacagctccgaacgggcctccaccattagcaacattttccttcgaaagctctattgctttcctcattagttcttctttggtcatagttataaaaaataaatatcgttagttttgcttttattgctacctttcgcaaatataaagaaaactaacgatagaataaagtgattaaattattttaagaaacaaacgagggagcattatcttagagcttccctaatattttgtccattacccagttagtcaaggtagcactttctccgtcgcatgagcagactgacttaccgagcagatgatctactactgcctgaataagaggttgttgaacatgctcaggattaccgatacagatttcctcccggccgcgttcggtgtgcagaccaatcggctcgtacgtaaagacagagaagcagatcatacctttatctccgataatttcgatgcggtcttcgcgggcggaatcatgggcaacaaagcaccatgaaccactgccgaccaatccgttgtcgaactggaagcaggcgctcagcgtatcttcggcaggataaagccctccacgattgctcttatatccgctggcttcgaggatgcagccgaacatatcttgcagcaagtcgatctgatgcggggcgaggtcatagaagtaaccgccaccggcaatatcagcctgtacacgccaaggaagattttcacggttgtaatccaaatcacgtggcggctgtgcaaagcggacttgtacgtttatgacattaccgatagaaccgttctctaccatttctttcactttctgaaagtaggggagatagcggcggtaatatgcgacgaaacagggaacacccgtttccttagaaatacggttgatgcgtgtacactcctcataagtgacagccattggtttttcaatataggcaggcttgcctgctttcatagccataatggcgtatgtagcgtgtgaagaaggaggagtggcgatataaatggcatttacttccggatcgtctatcagttcctgagcgtcatcataccattttctgattcctctttctttcgcataagcctttgctttggcgccatcacggctcattacagctactacttcagaatgttctaccttttgaaaggcggggccacttttggttttggttacttctccgcagccgatgaagccccatttaatcatcttttcactcataatatacctattgtgcttgttttaacaactcccaaagataaagctattttttattaagaacaactttattgattgttaactgtcagaaataggcaagggtctgagtttttactttaccagtaccagcatacgccgaaagagaacggataaagttcgggacctttgttcttctcaaagagtccgtaggtagagtaacgcatatacacgcctaagtccgcataaccggcttgtgctagtaagttgatacctagcgggcgtccgttcagtcccttgtcaatcgtcttcttcgatccgttgactttggctttggatctgaatccgtgacgtatttcggcttcgggacctacagcaaagaacaaaggacctttgccgttgagccgtgtttgccattcgatggagagcggaatgcggaagtagaaatagcgcagacggcttttgctgtactctataggctcttccgcctccatgccggaataaatttcggtcactccgtctatttcacgaaaagcatcattgccgtccaggcgcatactgcggtatccccatcctagtccgatggtgatcccccagttataggtaggtgcaaaagcgtgcgaaccggtaaacagattgccgcctatctcccatgaatgactggtgttgaggtcggcaccgttcgacggattgaatgagaggaagtcattggacagtcgggtgtagccgatgtagaatccgccggcatgtggctcgaacctgtttctcttgttgtttttcttcgagaaggggagagcgctcagcacggtacggctttccgtactctgcccgttcaggtagactccttcgaagatttgcgcgtttgttatcgtatctccgccggatgcgctttcgtagagtttcactttaatcttgtcgccttgttccttgatcacgatcttccgtccgttgacgtaaagtgttgtatcctgcggtgtactttcattttgtgccattccgctcattggagctatcatgagccatagtaataatagttttttcatattcgtatttctttatctgttttttattctttcttcatgaataacatggtgatcaggtcgtcggcatccagttctccttcgatatagataagggtagccgaatctttctttccggttttgaagaggataaagcggttcacatcctccttgagctggggaagctggtaatagccggacttgatttgcccgttggaaaccacttctttcaccttctttgctttcttcttgtcggcttccaggcaacggagaatcgtaggtagtgcatcgctggcatccttgaacacaagacttttatagagagtcatctggtaagtttccagcatttcattggatagctctaccatagttacccctttttgctttccgtacttctgaaagacggtagcaatctgtagtccctgttgggcggccgcatgggcggcgaatgtaagtaacagggcgattagtgtggtacgaatgattttattcatcataattatatgctgtttttatattatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgaacacttcctcctcgctgaggctgacgtcacggaaggcgaccatcgcctgttcgcggattaaatgaacgtccgtatattccttaccgtcaatgattacatagttggccggtgcaggggatagatgacggtagataccggagatgcctacgagtagcagtatggcggcagcggcagcactgagactgtaagtcagatactgtctgatcgtttttgtctttttctcgaatggggcgagttctggcatttcgacggcattacctataccggagatttccggaagttccttctgttccgcttcgaagaaagcgaacaccgggcgatatacctccagatgttccggtacgagcccttcggcaaagaaacgtcgtagtctgcgctcttcctcgcaggtggtttctccttcgaaatatttgtttagcaaggtttctatatctttcatgctttgttcctcctttttcgttcttgtatcgtttgcaaatagacttcccttactttcttgcgggccctcgacagattactgcggatggcttctgcgttgcagccggtgatttcggcaatctcttccgtctcgtactcttcgatgtctttcatgcgaataatcgttcgttgcagcgtaggcagggagtcgataatttcccgcatcaatctgaactcatctttctcttccagcagtcgctccggagtagccgaaggggtgggagcctgtacacggtcgagtgatagagtgtccggtcgtttggcacgccacatatccatgcagagatgatgcgtcatggtcatggctacggcttcgatacttctgtactcgtctagcttctggcgcagattccacagcttcagcatgacttcctgtacggcatcttccgcatccgaaggatcatctgtcatccttcgggcgtagttcagcagcttgtctcgaaggggtacaacggttattttaaattgtttcagttccatttacactgataagacggtggcggattaaaaacgtgacatcgaaaagggaatttttttcaaaagtagagcaaatttttgtcaagagcaactttattgattgttaactcttgggagctgtccggaaacagagcttctgttttgggataacaaagcatcggtttatggataacaaagcatctgattaatcataacaaagcatctaattagtcataagatactatgttaagtatggtaacaaacgaggtaaaacggactaagctcgggggtaaaatgagcaaaaagctgggaaaaaggctgattttcattcattgtaacaaaaagaaaggagggaactgtgattccctcctttacgtgtagtttaactgaaactactttatgattacgttgacaaagatacgacattcaaatgcgaaagtcaagtcttcggcgtattattttttatctatttatcaccatagtatttccggtaaatcttttgatactctttttctttttggaatttatccagccatgtattcaaactatcgagcaatgcgggtgattgcttgctgactgcccatgagtagaattgagtaaaactgattgcggtattgatatctacctgaggcaatgaatctgccactgcacgggcaatgctttcatcacagacggcataatcgatatctccatgagcaactaacgaaatcaactgctctgaaccgtatttctctatttcctttatataaatagtatctccgatttcatttcccagattctgaatacgtagaatagaaggcgagccttttaccacatgaagtgtcttttgggcaaggtccaattggtttcggatataaagtgaatcattctccccgttcgcttttcgttgcaccagcacctgcttgttgagtatgatgggggaggtgagaagcagagaatctttcagttcgctggttgccagtattccgtaggctatgacatcgtagcgtccgtcgcttaatcctctcagccgttcgtcgaagctcatgacaggagtgatttcagttttcagccccttgtcacgtgcgaacgcttctatcagttcataatggaatccggagacagtgtcactgtctacatagaaactgattgaattatattcggtggctacatgcaggatgccttctttggcgatggctgcataatcacgcggatgccccagaggtttttcttgcttaccgcaatagcggacagagaagatgagtgccagtacaatgactaccggcaacagatatctgaatagtctcaatttcgggtgcgttttcataaatcatagaggttttgttaatcatagaagttccatgaaagtccgaatttcagcacacgtgggttaatggggtaatgaggtgccaggaagtagttaggtttgctcattccctgattgacgtgatacatcatcacatagaaacgggtacgtttcaaatgtaagttagcataaacattcactatcggataaccgcctatctctactttaccttcttccggttgcaggtagaactgctgtgtagcaggcatataggccggagcatcatatttagtgaagtaacgtacatcagcacctaattgtacactcaatacttttttcgccagcttgaactgcatatagaagttatgatacagcgaaagttccggtaatggaagtacagcctgatcactggatttctgccagattacttcattgtccagatggaagattcccactttgaaatcctgattgaagcaagctgatactacctgcaagctaccacctttttgttccggtaatgcctgctggttgaagtaagtatagttctttatgttttcaacgccggctcttaagcgggtcccccaattggctatgctcagctcgccttcgatacgggtgcggaattccttatccatatcatcatcccaccaaaaatgtttggagtggtaatgacgcatgtagaatggcgcaagtttattactgatttctccgcgtgcaatcacactgacggtatctttccataaagggatatttaagtcgatatctcctttgacatcaaactgtccgatagcctttcctgccattcccacttcaccgattgcgtgataatgaagaaagtttccctgttttttagtcagttcgccaccgatatagatttctgtctcattgtatttatcctgctttagcgggtctaggctcattaatgaatatttgctcagcttatgtgaggcaaaggctgtcaacccggcttttgcatatttgttgaagccttcgagcaaagcaatacctatggtattcttgactccgatatagacagtactgtctctgacgaatgtattctctttatcaaggagagtttgcttataatagttttctacattatcatccgaacggaaattatggcgcgaacgttctacctgaatggtatgtataaagctggtgaccggaacaaattcctgtttggcaggcatcgtatcattttctgcctgtggaatatcccggtggaatcccagattatagcgttgtgtcagaaagacatagaagtcatggttacggttggcactggcattgagtacggtagggatattgacagattcatattcttttcttccttctgccatttcttccggtgcggtaatgtagcggtcgtcagtgataccaccgttctcattcgttttcagatagttgttgctatagattccctgcacctgatagcggtcgccaatgtaactaccgaaaagcgcggcattaaaataagaagtgttttgattattatagtagcctcggccatacagataatcaatattaaagccgaaagccaacttcttgtttacattgactgaaaaataagatttgaaacgttcttctccattttgcttatttccggccttgtgataggtcaggttagtataaggaacattactattcgtaaagttaaattccgtcgggcgaatgaaaaagctggagaaagactccataaagatggttggttccggataacggcgctcaaagaagatacgcgacagacgcggtgaacctaaattggccagataattataatgtccggtgattccttctgtaagattcgtattctgaaagtgatggtaagttgtatctgccggaatcattgtccggtcgcctaattggttcttgatacgccacatatatagtgtaggcggcagtccctgtacttcaacattggcactatccagtttgtccggaatcatggcagggtctacctgattaccatattggtcgcgtccgttctcgtcgatttgctggcgggcagggttgagctgtgcatggatagcactcagtcctacaacggagaataatatatataatagtaagattcgtctcataattggaggcaaagatacttacttaaattgagaattgagaattgagaattgaaaattatgttgcatcgcgctattatctagcaaataattctcaattctcaattttaaactcttaatttattaaacttcgtggattaattccattccttttttgatcgcttcctcgttcataggaatcaagtggtgatggcgttccggaagagttttcttcaatcctttgatgacgttttccagagttacgataggacggagttgcagtaaaccgccaagtacgatcatattgaaggctttcgcattattcatttcgttggcagcatccattgcgtcgatgcgatatactttgatatccttgcgggtaggagggttgataatcccatatccgtcatagatcaggataccgcccggctttactctgctttcaaacttttccagtgaaggctggttcagtatgatcgccgtatcatatttactcaggatcggtgaagagattttgtcatcgctgacaatcactgtcacattggctgttccgcctcgttgttcaggaccgtatgccggcatccagctcacttcttttccttccatcagtccggaataagccagaatcttacccatggacaatacgccttgtccaccgaatccagcaataattatttcttctttcattgttctgttgacttttgcgttattctttatcttttaaatcacccagcggatagaatgggaacatatgttcttccatccatttatttgatttttccggagtcatcttccagccggagctacaagttgatacgatttctaccagattggaacctttgccgttcatcgaattttcgaatgccttgcgtattgctttcttggctttgcggatggcgggcactgattgtaccgactgacgcgtaacataagcagttccttccagttgggcggcaatctcggtaatcttcaatggatagccgtgtagttcgacatcacgtccgtaaggacaagtagaactcttcatgcctaccagagtcgtcggagccatttgtccgccggtcataccgtagatagcgttattgataaagataatggtaatgttttcgccacggttcagtgcgtggattgtttcggcggtaccgatacaggccaggtcaccgtcaccctgataagtgaaaacgagacggtcgggccataagcgtttgatagccgtagctactgcaggtgcacgtccgtgagcggcttcctgccagtctatatccagatagttgtaggcgaaaactgcgcatcctaccggagagactcccaccgttttttcttccatgcccatttcctcaatgacttcggcaacgagcttgtgtaccacgccgtgactgcaacccgggcagtagtgcatggcattatcattcatcagagtcggttttttataaaccagattctcaggtttgattatttcttctttagtcataacttcttctccttatctgttggtgaaccgtataaaaaactccatcagcttgacaaagattgccgcgccgcatacgtagataaacattttaaaatcttcctttcctactacaaagtagacaatgatagcggcaagtgccaatatcatgaaaaggatgttcaatacgtttcttattttatcgggattcatcgtcgtttcgttatttgattattttttcttccagagcagttacaatttcatccggatcgggaacaataccgccgagacgtccgaaatgttctacttttactttaccattgacagccaggcggacatcttcgatcatctgtccggcattcaattctgtaacgagcatacctttcactttgtcagcgtaagcggcaatggctttgctcgggaacggccacaaagtgatggggcgaagaatacctactttgattcctttttcgcgggcgagttccattgctttctgaccgatacgtgccatggaaccgaaagctacgatcagatattctgcatcttcgcagttgatttcttcgaagcgtacttcgttttcctcaatctgtttgtatttagcctggaaacggatgttgttgatttccattgcttccggcttcagttcgagtgaagtaataatattcggtttacgacctttcgcttttccggtagcagcccacggacattgttcgataacttctgcatcggtgcggcgtggcttctgtgcaggaagaactactttttccatcatctgtccgattacaccgtcggcaaggataatagccggattacggtatttgaaagcaagttcgaatccgagtgcaacgaaatccgccatttcctgtacggatgccggagcaagggcaatcagtctgtagtcaccgtgaccgcctcctttcactgtctggaagtagtccgcctgactcggctggatggttcccaatccgggaccgccgcgcattacgtttacaatcagacaaggaagttcggcacctgcgatgtaggagataccttcctgtttcagactcacgccgggacttgaggaagaggtcaataccatctttccactacctgcgcctccatataccatattgatagctgccacttcactttctgcctggagaactaccatgccggttgtttcccacggtttcagttcggcaagcgtttccagtacttccgattggggagtaataggatatccgaagtatccgtccgcaccgcaacggatagctgcgtgggcgatggcttcgtttcctttcattaatacaacttcttctgccatattctttttcttttattctacttttactttatacactgagatacatccgtcgggacaaaccattgcacacgagctgcatccgttgcaggtatcttcttttacttgccaggcatagttatagcctttcatattcacctctttgttgagggcgattacatcgagcggacacgctactacacataggttgcatcctttgcaacgctccgtgtcgactacgattgctcctttaatttttgccataatctctattttattacgttatctttgaattcggttattgattatacatatctttgtggtagaaattcaggatatctatcgccattgttctggcttgaacagcggggctgtcgggattaagatcgatagcatactggtagttatccagcgcctgcttccaatctcctttttttcggtaggcatttccccgtaaatagtagagcatatctttatctttctcgacagaatcgtcttggagaagttggtccagttgcttgattgctatgtccacatccccttgattgataagctcttttaggttgtctatttgctccattttctttcgtctttcgggattctgaatcgcaaagatagtttttatttatgtaaatgggggaaaatgagaaaggaaatttacctccttttgtttttattgcatattgggtgaataaataatcaatattaaatatgccttaagataattcttgagtataaaagacagaattagagaagatgtatttatgttaatgacaggtaaaaccgtatatttgtaagccgtttatctgcaaacaatgcataggcggtaaggtgaataacatctttatttatgtgcagaatcaaagaataatatggaaataaaagaacgtatacagttgctgctgtccgaaatgaacaggggggtatatgagaaagaggctgaaatcggtttgtctttgctggctgctttggcgggcgaaagtattttgttgctgggacctcctggggtggcaaagtcgatggtggcccgtcggttgaagagagcttttgtagatgcaagggcatttgaatacctgatgtctcgtttctccacacctgatgagatctttggtccggtgagcatcagccgtctgaaggaatcggataaatacgagcgtgctgtggacgggtatctgcctacagcggatgtcgtgtttctggatgaaatatggaaagccggtccggctattcagaatacgttgctgacggtcatcaatgaaaagctgtttcggaatggagatacggaactgaaacttccgttgaagctgctggtggctgccagtaatgaactgcctacgcagggcgaaggactggaagccttgtgggaccgtttcttgattcgcattatcagcacttgcgtgaaacaggaggaagcgttctatcaaatgttgctggacgatgatgacgaagaagaacaggaagcatgtcggtggcagatttcggatgaggaatatgctggatggcagaaagagatacggcagatcaaggtatctgccgaagtcctgtcctgcatcacagaaatccgtaagaacctggagaaagtcgagattcaaggctcggaagtacatcggaatgtctatgtgagtgaccgtcgctggaagaatatcgtgaagctgctgaaagcttctgctttcattcatggtcggaaggaagtctgtctgacagatttattacctgtttaccactgcttgtggaatgaaccggaagagtgtgcggatatccggcagatcgttgtccgtgcgctgtttgttccttatgtgaaggagatagccgctatcaacttatcattaaagtcggacctgaaagtgagccgcgtgcgtgaagcattggagaaagcccgtcagaaaggtgaccgcagagacgatgatttgatgatcatcgatcatttctactatcagatagagaatcatggtacgggaaatacctacatatttattgtggattataagaatctgaaagaatacagtccgaaggatgttcctgcaacaggagtcatgtatgccgatccgctgaatccgaagcgaacgattatacgtactttttcggatgccaccaaaatgaaggaacaaggtgccgaaagggtgacactttacagggatgagaagaatctttatatcaatggtgtccgctttccgatgcgtcggctgaagaggggagagcaacagcagttgtggctgggcaatatgactctcaccgaccgggattatgagacggagttggagacagcccatggccggattgagaaattagtaaaagacttgtctgagaatatttttatttccgaagaagataaaaaaggggtggcacaatatgtggcgacccttcgtaaagagattgcatgggcacgtgtggatgtccgtaaactgagatacggcgatgagtcttagatatgatgctgcattttatgtgcaggtgctggataagtatgtagcgaccggagagtgtgcggaggcggataacgaaccgctgtacgcttacctgctttccgtcatgaacgatccgatgataaagatacaagtcctgagtgatgaactttgtgcccgaatcttttacgatgcaatgagccagtttatccgtctgaatctggaaaagcaaaagtacaatatgcagaaaagccagtcggaacagcaaggaatggaacttgtgctggaatggtccgagaccaagcggaaagacgggtggcaggctttactacaggaggttgccgacaaacatgaaggtaatggtttcgacaaggcattttatcaggggcagttcggcaatgaagggaaatatgcggatgaggaagtctgggagaggatggtggacgactggaaagaggctttccaacgggatttgcaggagcaaaaggaaaaggagatagaacagcgcaaagatgatttcgaacgcagacttcatgccaatctcaggaatatccccggatatatccggcaaaataacatagagaaagacgagttctatcaggcttggggcttgatgagcggtatgtggaatacggtggattttgagcggatacgcaaaatcgtccgcattcagaaagaatatccggaagtggtcaaggttgccaataagatggggcgtatggctgacgatgaaggacaggagcagctacatgtcgcgcaggggaatgtatataagatggagcattcttctaaaagtgacattttgggtatcacagtagggaatgacctgaacgcattgcttcctacagaactggcgcattgtgccgatgatgagctggaagacttgtttgtctataaatatgttacccgaaaacttcagaccttccgctataaatccgagatcatgcaaccggcacggcgactggaaataaagcctgctacgcagaaaggaccgatgatagtctgtctggacacttccggaagtatggtcgggaaaccggaaaagattgcatattcgctgctgattaaaatattggaaatagctgacaggcaacgtcgggactgtttccttattgccttttctgtatccatcaatccgattgatgtgcggagagagagggcgcggctgcttgaatttttctccaccacctcttgtggagatacggatgctacccgaatgctgcaagctatcttccggttgcttcagtcaaaaaaggagtatatgaatgcggatgtgttatggatcagtgattttaagatacctttatccgtgccggaactgactgacaagatgctggaatatagaaaagtggatacgcatttctacggtctgcaacttgggattgcggagaatgaatggagtcctttcttcgaccgtatttatagaattgattatactccttcccgacgttactgattgttttttggaggattcggtttatttgcttaaattgccaccggatataaagtacatctttcaaatgcaataaaacgatgttagatattattctgattatactaggtgtgttatgcctcattaccggactgatgggatgtattcttccctttctacccggtcctcccgttgcttatttgggattggtccttcttcattttacggataaggttcaatacactaccacacaacttattgtatggctgctgattgttcttgtcgtgcaagtcttggactacttcacccctatgcttggcagcaagtatagcggtggtagcagatggggcaattggggatgtatcatcgggacccttatcggccttcttttcctgccttggggagtgattttcggtccgttcttgggagcagttattggcgaattgctagggaataaagagttttctcaagcacttagatcgggggtaggatcattgattggatttctactgggaacattcctgaaatttgtagtttgtggctatttctgttatcagtttatagtcgggtttattcgatcatagaattcgttttgtacggatttgaattataagtttttgcttcttttcggaacaaaaaggggcaaaactcgacctcgccaacaaagaaacgacattccgtattcagtcctttcagccttgtccgcaaatgcccagtcagaaggggatagcggctgaagggggcattttataccctgtctttaggagcttctgaacggtgcaagtggcttcagtcccttcagcctgaaaaataatccattcgaacgtcggtagttactgacttaatagagcctgtgtttatctcaaacaaaggttctgtttggaataaacacaggctctgtttgaggcaaacagaccttctgttttttatctgaactattggttagtttattgatttgaagtaagccggtatcccaccaatcttaccctcggtgttgagtacccttcgcctcggtactgagtgacgtttagcgccgagcttataaaattcacctcgcatgcggagtagctacaacttgcatgcaaagagctataaccaattaactatggatttattattgaggatgaaaggactgaagccacttgcaccgtttagaagctcctaaagacagggtacaaaatagtgccttcagccgctatccccttctatcaagtcgtttgcgagtaaaactgaatagtctgaatactgaaagtactccaattgtagcaatggcatttttattattttcatcctattcgagtactaaattgatgtatgcccgtcctaactataatagcacattgagtttgtaccatgaaaaagacaatcgttgttcttctttttatggcttctttaggtttattttccgttctcgtcgcaggcgaggtttatgtttctccgcatgggagtgacaggaatgcaggtaccaaagaagctccttatcttaccttgaatcgcgccatcaagcaggctcgtgaatggagaaggctgaatcgtcccgaggcggccggaggaatttgtatctgtttggaagacggggtttatgcacagtccgctcctttgtttatccgaccggaggatagcggcacgcccgattctccgacactcatccgtgcggtggagaatgcgcatcctgtcatcagtggcggagtggcagtgaccggatggaaaaagggatgtgatgatcctcggattgcaaaggaattaagatcaaaaatatgggtggcaaaggcgccatcctttggaaatagaatcgtagaaacccgccagatgttggtagacggcaacaaggcccagcgagcggcacagtttcctgatggagtgatggaacggatgattgatttcaatccggaagaacagacgataataatccctgcttctcagatcggaaacctcctcaatgcccgtcgactggaaatgatagttcatcaacgttgggcgattgccattctgcgtgtgaagagtatagacgttaggggagaacaggccgtcattcgctttcacgaaccggagagtcatctggagtttgcccatccgtggcctcagcccgtcatcgggggagagaaaggcaactcttccttttgcctgacgaatgctctggaactgctggaccaacccggagagtggttgcaggaatatccgtcggggacaatctactattatccccgctcggaagaagatatggagactgccgaagtgatcgttcctgctctggaaacattgatgattgtagacggcacattggaacgcccggtgcggcatattcgagtggaaggaatcacctttgcccatacttcatggatgcgtccttcctatcagggacatgtcactttgcaaggaggttttcctctgctggatgcttataaactgcatgaaccgggacttccggagaaagcggaactggagaaccaggcgtggattgcacgccccgaaacggcaatacgtgtacggggtactgagcatcttacgttcagtcgctgcaggttccggcatctggcatctaccggactggattatgaatgggctgtttcatcttccggcatagagaattgtgtcttttcggatatcggtggtacaggcatactgatcggtgcattccccgacggaggttttgagacgcatgtgcctttcatccctccggaagaacgtaacctatgcacggacattaccattaaaaataatctgatcactgatgtgaccaatgaagactgggggtgcgtggggatcggtgcgggatacgtcagcggtatcgccatttcccataatgaagtctgtcacttgaattattcgggtatttgtgtcggctgggggtggacatcgctggaaagcggaatgaaaaacaaccggatagaagccaactacgtacatcactttgcccgtcgtctgtatgatgccggaggactttatacgctttccaaccaaccgggctccgtgatgcggaataatcggatcgaacatctcgaagaagcaccttacgccaccaatgacagggccttttatatttatttggatgaagctacggacggatatacgattgaaaacaactggtgtccgactgaacgtttcgactcgaatcgtcccggcaatcggaatgtatggaaaaataacggaccacaagtgacagaaagcattaagaataaggccggaaggataaaaccggagtaagtacagtccgacactgagcctatcgcagtgtcgggctgtgcaaaaagtggggccatagagacttgtgaagtctgcatgagtatagataaataaagataaaactaataataatagatcataaatgaaacctactaattaccatttgttcgatttccttgatttcgatacagagttattaagggatgagtcactttggaaagcctgtaaaccgacagccgtttacgaaaaggatggggatatctgtgtcacggtcccctttcaaaaacagctgttagctaatgatatggttgcggatacggctgtcccccgagaagaatatacgttgatcatacgccagtataatatcggcattacccgtctgtttcttggatttggtgaatatgaactgacagatcagtcggaaatgctgcaattcagcgaacggattcgcagagtacctttgtctgtagagaagcagggaggcaaatggattcttttcacccaagacgggacgaagcgtgccgttatcaatgtagaagagccggctttggaccgatggagcgagttactgcccgatcctcaggaaacactggacatcactctgtatcctgacggcaaacgggaaatccgcctggcagcatacgatcatttctcgcctccccgctatgacggactgcccattgccttctgcaaacggacgggcaaaaaggaacgtgccaccctttctttcgagagccggccggatgaatgctttgcaggaaccggagagcgtttcttcaaaatggacttgagcggacagacgcttttcctcaagaatcaggatgggcagggagtaaataaccggcgtacctataagaatatacctttctatctctccagccggatgtacgggactttttaccatacctgcgcccacagcaaactttcgctggcgggacattccacccgctccgtacagttcctgagcgatcaggctatgctggatgcatttgtcattgccggcgatacgatggaagagatacttcgcggctaccgtgacctgaccggatatccttcgatgcctcctctctggagcttcggagtgtggatgagccggatgacttatttcagtgccgacgaagtaaatgagatctgcgaccgtatgcgtgccgaacattatccctgcgatgtcatccatctggataccggatggttcagaaccgactggctgtgtgaatggaagtttaacgaggaacgttttcccgacccgaaaggattcattcagagattgaagaagaacggttatcgtgtgtccttatggcagttaccttatgttgctgaagatgcggaacagatcgaggaggcaaaggcgaatgagtatatagctcctctgacgaagcagcaggacacggacggttccaacttctcggctctggattatgcgggtactatcgactttacttatccgaaggcaaccgaatggtacaaggggctattaaagcaacttctggatatgggagtcacctgtattaaaaccgatttcggagaaaatatccacatggatgctgtctacaagggcatgaaaccggaactgttgaataacctgtatgccttgctctatcagaaagcagcttacgaaataacaaaggaggtaacaggggacggcattgtctgggcacgtgccgcttgggcgggttgccaacgttatccgttgcactggggaggtgactcctgcagttcatgggatggcatggccggttcactcaaaggaggcctgcacttcggtttatcgggctttgccttctggagccatgatgtccccggattccataccttgcccaattttatgaactcaatcgtagcggaggacgtctatatgcgctggacccagtttggagtgttcacctcacacatccgttatcatggaaccaataagcgggaaccctggcattatccggctatcgccccgctggtgaagaagtggtggaaactgcgctactcgttgattccctacatcatagagcaaagtaaactggcagtagaaagtggctggccattgttacaggcactcatcctgcatcatccggaagataaactctgctggcatatcgatgacgaatattacttcggcaatgatttcctggtagctccggtgatgaatagcgaaaaccgtcgcgacatttatctccccgaaggacagtgggtgaatttctttaccggcgaacggttgcaaggcggacgctggctgaaagaggtgtatgtgcccttggaagagatgcctgtttatgtgcgtgagaatgccgttatcccgatttatccggaggaagtgaattgtacggacgagatggatttaggcaaaagtattgccttgcgcatagatcataattacaaaggattttggactaaataaagaatagcgatgaaaacttggaaaacaaacttagaagaaacgaaacagcgttatataaattggtggaatcataaaggaattattctttctatgtgggaacactttcaggaaggcgtgaaaccgcacgccgacattgctccacctgctccggcaagggatttgtcgcagaagtggttcgaccctcaatggcgggcggaatatctggattggtatgtcgctcacagtagtctgatggcggatatgctgcctgttgcaaatactcagttgggtcccggctcactggctgctattctgggcggagtgtttgaaggaggcgaagatacgatctggatacatcccgatccgaactttaatgatgagatcgtattcaatcccgaacatccgaactggctcttgcataaagaacttctgaaagcctgtaaggctaaagccaacggaaactactttgtcggtatgcccgacctgatggaaggactggatgtattggcggctttgaaaggtacggatatggtattgctggatacggtgatgcagtccgaagtgctggagcaacagatgcagcagatcaatgacatctattttaaagtctttgatgaactctacgacattatccgtgaaggggatgaaatggcattctgctatttctcttcatgggctccgggcaagatgagtaagttgcagagcgatatttctaccatgatcagtcaggatgattatcgtcgttttgtgcagccgtttattcgtgagcaatgtcagaaaatcgattatacgctctatcatcttgatggagtgggagcgatgcatcaccttcccgccttgctggagattgaagaactgaatgccatccaatggacgcccggtgtcggcgagccgcagggaggttctccgaagtggtacgatttatataagaagatactggcaggaggtaagagcgtaatggcttgctgggtgactctggaggaactgaaacctttgttggaccatatcggggcagacggagtgcatctggaaatggatttccacaatgagagggaagtggagcaggcaatgagaatcattgaggaatataccggctcttcttcgtctgtgtctgcagatgttcacacgaatcaacccgttggagaacaggataatgcacaggaaagtattcggatcagagaagaaaagtctcaggaagaggatcggatgaaacctttgtatgatgccattgtagccggaaaattggaaccggctgttgaagttacaaaggatgccattgctgccggggtactcccgcaggatattatcaatggttatatgattacggctatgggcgaagtcggtcagcgttttcaggacggcaaggcctttgttcctcagcttctcatggcggggcgtgccatgaaaggagctttggaacttttgaaacctttactggcggggaatgcatctgctactatcgggaaaattgtgatcggtactgtaaaaggagatttgcatgatattggaaagaacctcgtggcttccatgctggaaggttgtggcttcgaagtgattaatatcggtattgatgtcacttgcgacaagtttgttgaagcggtgaaggaaaacaaagcggacatcttatgtatgagtgccttgctgactaccactatgacttatatgcaggatgtgattcgggcattggaagaggcggggatccgcgatcaggtgaaagtgatgatcggaggagcacccgtgagtcagggatttgccgatgaaatcggtgctgacgggtatagtgataatgctaatactgccgtggcggtcgccaaagtgctgatggggaaaagagattaagaatattttaattgttaatacttgaattatgcatgcgaaattcttagacacactggattggggcattctgattgcctattttctgattcttatcgccattggtatatgggcaagttccaaacgaaagaaggggagcagtctctttttggcggaacattctttgagatggcaccatatcggattctccatgtgggggactaatgtggggccgtctatgttgatagcttctgccagtgccggatttactaccggcatcgtttcgggcaattatgcctggtatgccttcgtttttatatgcctgcttgcttttgttttcgctccccgttacttgggttctcgtgtttccaccttgccggagtttatgggaaagcggttcggacagtctacccgtaatatcttggcatggtatacgattgttacaatcttgatttcctggctagcattgacattgtttgcgggtggcgttctgattcgtcaggtattcgatataccgatgtggcagtccgctttgatattgctgatcatatccgcattctttacgatgctcggaggattgaaagcggttgcctacacgaatgtttatcagatgatcctgttgattcttgtttcggctgcgttggctattgtaggaatctataaagttggtggtatatcggctctgacagatgccgttccggcagacttctggaatctgttcagaccgaatgatgataccgctttcccttggttgccgattattttgggatatcctgtgatgggagtatggttctggtgtacggatcagtcgatggtacagcctgtgttggcagccaaaagtctgaaagaaggacagttgggaacgaactttaccggatggctcaaaatactggatgttcctctttatattcttccgggtatcatctgtctggccttgtttccgcagttggagaatcccgatgaggcgtatatgacgatggtaacccatttgtttcctgtcgggatggtggggctggtgttggctgtgttgactgccgcgcttgtcagtactatcggatcggcattgaatgctttgagtaccgtgtttacaatggatatttatgtgaagaagattcgcccgcaggcgaagcagaaggagatcatccgggtcggacaagtggtgacggtagccggtgctctgatatcggtaatcataacgattgccattgacagcattcacggactgaatttattcaatgttttccagtctgtattgggattcattgcacctcctatggcggcagttttcctttttggcgttttctggaagcgtacgactacgttggctgctaacgctgccctgacagtggggacggtattcagtataggagtaggtgtattgtatctatgggtatttcctgcggatcaatattctgcatggcctcattttatgttattatccttctatctgttcgttattatcgggatagggatggtagttgtcggtctattggataagactcctcagacggcaatattgaatatggagaagatcgaagaaaagcctgcccgcattgtacttatcttatgggggttgcttatcgtaactatgatagggctttatatcttctttaatggccattaaagaagatataaagctgactaaaaagtcgatagtatcttaagtctcctccttcgggaaggaggagtacccgtagggggaggtggtaggtaattatataacttgtttattatcattaatttatttcttcacctaccacctcggtcttcgaccactccttcccgaaggaggagaatggtggtactaccgacttttagtaagcccccgatcacaaatttatctgtgttttcttttgcgataacagttttcgtaagtgcacagtccacaagtgtattcaagcttgcggacattagtgcccgttccgatgacgccactaactgatttgatgggtaccatgaggctggaatctgtcaaccggatgccacagggagcagctatggggaacaatgggaacagtttttgttgttccgaaacgtgccatccacagtatcctgggctgtatcggttggtatgtttccagttcttctcccgtatatattcagccaaagcgacttccatgcaatcagccgtcttttctgcaataatactccctaacgagtctgctatgtatattttgaccatatcttcttcttgttgcaacgtatgctggaatacctcaaactcagttccggcagtagctgcaaaaaagacaaacgcttccgatcctcttaattgacgggcgatggttttaccaacagagaaaacggtacttttactttgtgtagaaaaagtgttttgctcagggctccgtgtgggaatggtgtcttgtataggattgacagtgggtggatggatgctttgtacgctaagagtctctttttcgatatcaagtgtaccttccataaagaagaatgcgaaccgagggcgaagcaggggaataacccgttttagcaacgtattagtctcatctattaccatctgatccggtatagaatctttgtatcccattgcttcataaatttcggacgatgggattcgtaagtcttgataagtgagttcttgctcaatcattattaattgacattatctgaatgacagcctaatttcgagtttcattgaactcttccaatgctgtataaaaagcatttatattagctaatggcgtatatggcggtatatcgcaaccgctcgacagaacgaagttcggatatgcggcagtggcttccaataactgtagagtcgcttttttcatttcctccggactcgacatcttgaaaagactgaccggatcaagattacccatcgcaagagcatcggcaggaacttctttcaatgcttcttccatgttgattttatttccgaaatgataggctgccgcacccgtatataccatagcctgggtgcaatttcctgtattcccgcaattatgaagtacaacggtgaaatgatcatcctgaaccttctcaactatttcttttacgaatacagaagaatactgcaggcaatcttcattggataataatccggcagcaggttccgccattaccactccattcactccggtcgctttcagggccatgcagtatcgaataatgaaatcggtacatttgtggagcaaagtgttggctgcttcgagattgatataaatcagcatcatgatttcggacatatcatacaagcgtcccgctaatgaataaggaccgatacaaccagccagcaccggacggtctgtgatattctttgcagtcagcatattcgctttgagatattgcgcgatccttcctttattcagtgctggtatttccaaggcatcaatggcagcttcgtctgcaagcaaacgaccggatacgcttggtacttcattctccggaaatataatttcggctccgaatgcttccgcctctaccgttaaatccatgataaccgttgcggcagcagcaggatatttgtcgcagagcgctttgattgcttcataatgcacctgtccgttcgttactgcatcatgaaccgtctttccgataagctcgatgcccggatgtgtcatgataggaatggaaatgacctttttatttaggatcgtctgaccgatccagtctttcatattcagtttacccataacttctgttttttaacttcgtcatatagtaagacgatattattgttcttttgtaatcttgaagtttgcataaaaaatagatgattattataaaaaactatgtgtcataattgtatctatgatattttacgcactagaatcaacgtaagtgaaggattttagactgaacatttcattgatcttaatggcatattatataaaatatctcggcggataatgtactggagaggatgaaattattacactttatgcgataataagttggacgttacaaaaataacgaatatatttggtgttaaattagtatcatatagttctcttttggtataatggcaaatagaaaaatgatgcaatgtaattctttaatagtacctactttaaaaattgaaattatgaagacgattaagcaaattgtattttgtgtctcattactacttgtaatgaattgtttttattcttgttcaaactcaaatgatgttgttataaatacacaacaaaatcaagaaaaaacacaagatgttgaaattcaagagttaatagactttatagaaaccttgaatgctaataaaatacagactcgtggtcccttttggaatcgaataaagcgttttcttgtaggagatgcttggggttatggttggggagtaaataaaggtttaacacctagaggtggcttgattacggctgttgtattctcacttatttgtgcggcttcagatgatgatcttcctagaaattggtggcatttgagttcaaattggaaggtatacgatgctccgttaagaccttatgaaataattggaaatgatcataataagacaatatataatatgatgagggaagatcccgtaatagctaatggtactttttctaattattatttatataattctactaacaaaaaattgaaaagttatggatatacagaagaaatgcccctgttgcttcagacaagattgctggaaataatggatctggttaagaaaagtacttctgttgatcaactgatgaatttaatgaagcaagaatttcctcagcgagtatctgaatttcagcttgtagagagttatattaatggtttagtgaatatggatgataaatcaactgttcgtgattatactaaacaagtatatgcccaaattgatgcttcatctttagatgtatcagctgtttctcgattaaaaactatgatagctattgctgaaaatagcaaatttttgtgggttgaaacaaaatgatgattgattaagggagctttcgttttttctctttttattaaacacacttattatgaaacaaaacaaatgcctgctagtgggattaatatctttgatgttcagtatcaactctttgtatgctcagaaagattcactgaatgtttcaactaataacgagtcatataaacgagtatatatcttggatgtcgggttagggattggttttactggtatacaaaaaaatggaagcagctcttggtatataggaaataataaaaatgatgttccttttgtttcttcaatacaattgatgacttataccccttacagtaatataggatgtggattgttttattatgactatagtaatggtacaaagaaacatgatggagtgctatcatcgggaatcaatgaaaaaaaatcgttctattatgtagctccgcagatttcttttattaaacggcaggctggatttttggatgggattatgtatgtgagtgctggtattggatatgttaattatagaagtaagggaacaatatcgcagttggagaattataatacaacatgttcgacagtgggaggcaatatggggattgcttatgaatatgcttttgactcccgcttgggaattaggttgggtgtgaattgtttgtatgctaaaattaaaggacttcacaaaaataccagtataggtgaattgtctatacgccctcgtgaaaaatttcatttaattgttccctctttggaaataggattgtcttattacattgttcaatggtaaacttagtcataagtgtatatagcaatcttcttcaacagatgtgttatagtagatggctttaacttgagaaagatatagaaggaaaatgaagacaaagactatggttatatattccttgagcctcatgttttaaaaataaggtgggatatttattaaatattccaccttatttttatagattttcaggcattattttaccggaatcttatcaatacgattttgatggcgtcccccctcaaactgtgttgagaagaactctgtcaatatcatgtccgcctcctcagtgctgatgaagcgtcccggcatcacgagaatattagcgtcattatgttgacgggccagatgtgcgatctctgcattccagcaaagagcagcacgtattccctgatgcttgttcagagtcatgttgattccgtttccgctgccgcagatcgcaataccgggataacattcacccgattctactgctagggccagcggatgggcatagtccggataatctacgcttgcggcagagttggttccgaaatctttgtaagcccagccttttacttccagccagccgcgaacatattcttttagttcaaaaccggcgtggtcgcatgctaatccaattgttttcattaaatcattgcttttacctgattatatacgttctcggcagtaaatccaagtttttcatccaatactgtgtaaggagcagagaaaccgaaagattccaatccccatactttgccgtggcaacctaccagaccttgaagagtgacaggcaaaccggcagtaagaccgaatatcttggcatcagccggaagaactgattcctgatattccttagactggctgcggaacagaccttctgatggtgcagatacgatacgaacttttacgccatccttgcgaagcaactctgtaccggctaccaaagtagacacttcggaacctgaagctaccaggattacatccggattttcgtctgaaccggctacgatataagcacccttggctgcttgttcgtaatcagttccggcaggcaggttagcgatattctgacgggagaagatcagacctgtcggagtagacatattttccatggcaagtttccatgcgatagtcgtttcttccgcatcagccggacgaagtaccaacatagagttgtgtcccttgtggtttttcagtttctccatcaggcggatttgagcttcctgttctaccggttcatgagtaggaccgtcttcacctacgcggaatgcatcatgagtccagatgaacttcacaggctgttccatcagagcagccatacgtacggcaggtttcatatagtcggagaatacgaagaaggtaccgcaagcagcgatcacaccaccgtgaagtgacataccgatacagatacaagccattgataattcagatacaccggcctggaagaatgcaccgctgaaatcgcccttcttgaaagaatgagttttcttcaggaaaccgtcagtcttgtcagagttagaaaggtcggcagaagcaacgatcatattttctacctgcattgcaagagcacccagaacagttgcagaagcggcacgagtggcagtacctgctttttgttcgatggcagcccagtctactttaggagctttgccggagaagaatgcttccagtttagctgccagttccggattggctttggtccatttggccttctttgcatatctttcagctacgattttctttaattctgctgctctctttgcatacagttcggctacttccgggaaaatcacgaacggattgacaggatcgccacccaaattcttgattgtatttacataggcgtcgccaccgagtggagcgccgtgtgtagcacagttggcttcgtagctgctaccgtctgctttgcgtgcgcctttacccataacggttttaccgataatcagagtcgggcgctctttttctgtctgagcttctttgatagctgcacggatttcgtcaggatcattaccattgatgctgagtacgttccatccccatgcttcatatttcatggcagtgtcttcaacggttacatctttcgtttctgtagaaagctgaatatcgttggagtcgtagaacatgatcaggttgtccagtcccaatgcaccggcaatgcgtccggcaccctgagagatttcttcctgaataccaccatcggaaatgtatgcgtaaatagtctgattcattacttcattgaagcgtgctttcaggaatttagctgcgatagcggcacctacagcgaaagtatgtccctgtcccagcggaccggaagtattttcgataccacgcatgatgtctacttccggatgtcccggagtagggcttccccattggcgaaattcttttagttcgtccaaagtgaacttacctgtcaatgccaatgtagaatagagcatcggagacatatgacccggatcaaggaagaaacggtcacgaccttcccaacgcggattttcaggatcgtatactagaaactcagagaagagtacatttacaaagtcagcaccacccatggcgccacccgggtgaccggaattggctttctcaaccattgaagcagcaagaatacggatgttatccgctgcacgattcataagtttattatcgttcatatctttaataattaatagatttgctagtctgtcaatgtgccaattacttggcatatttctcataatgttggcaaagatagctctttatgtgtaattaaccatccaaaagagctatcttttttgtaggctttttaacagccttcttgtttacaatacagtaagtatttactattagattactgtaactctaaagtaacaattgacttagccggtagttttaccttcataattcctttattgatttttacctctttgaaggaagccggttttacaatattaggtttttcgaaagagttgtaatcagtcagattagcagaagtcaggatttctccaatcgcctttttggcatttacgtccggaagattgactgtgatttcctgtgcgttgtctgcatctacgttggagagagaaatatggatcactccgttcttgttcttagaagctgttgcgctgaccatgggaactgtacggttatcgcgtacgttcattttctcgcaagtcaggtcgagtggaagataggttgcatcctgatgcactttgtacatcttaaatacataataagtaggagtaagtaccatatctttgtctttagtcaggatcatagattgcagaacgttgactatctgagcaatgttcgccattttcagacggtcggtatatttgtggaatacatcgaggcttaaagaagcaacgaaggcatcacgcaatgtgttttgctgatacagatgacctctgaccgttcctggttcttcgtcccaccaagtgccccattcgtcaagcaaaagggcaatcttcttgtctttatcatatttgtccatgatggcgcaatgttttttgatgacatcttccacttcaagacatttgcccatcgtccagtaaaaatcatctttgttgaatttggttgccgcacctttgctgccgctccatcctgtaactgtatagtagtgtaaggatagaccttgcatccggtgaccgacacgattcatcagtacatccgtccagttatagtcgtaatcactggcaccactggctatcttaaacagatgattaccgtcatagttacggcaataagtagaataacggcgatacagatcggcataatattcaggacgcatgctgccgccgcatccccagctttcatttcctacaccgagatattttactttccatgccttgtctcggccattcttgcgacgcagatttgccattggagaatcaccgtcggaagtcatgtactccacccatttggcgagttcttctaccgtgccgctgcctacgtttccacttatatatggttcgcagcccagcatttcgcaaaggttcagaaattcgtgtgttccgaaactgttgtcttcaatcgttcctccccagttgttgttcaccatcttcgggcggttttctttgggaccgataccgtccatccagtgatattcgtctgcaaagcagccgcccggccagcggagaacaggaacagacaagtcttttaatgcattaaatacgtccgtgcggtatcctttgatattaggaatatccgaattttcgcctacccaaagaccaccgtagatacatgaacccaggtgttcggcaaattgaccgtagatttccttcgggataatttctttgccttggtcggcatgtacagtgatggtagcactcttttgtgcagaaagagataccgaggctgccagaaaggccgtgctgactaatagttttgctttcataaatggaatttgtttaaatgattatatagaagtttgatttttacgatgatcattctcttgttcttacggttacttcagtaagcgtacttcataaacggcagaggtccattctgttccgtccggcttaaaaagaatctcgcagcttcctacttttaatttacggggcaggagataacagagtctgataaaaccgtctttgtcggctttgctcacagtgggatgaacggtcagtttttcgttattcagcaggatcactgctttgttacggtcttcttgccgtacggtgatcataagctggcttgcttcttcttttattttcaggttatagctgaaccaacctttagcccggcggaaatgacggtctttgtgggttccggtttcggaagcttcatattgaatgctatgatcagattccggttgctgttcaccggggaagatcaggtcaactgtccggttcgccagttcggtcgctttccgttcggctgtagccatttcttcctgaatcgttttgaactgttcttcactggcttggcggaagtaaacggcataacgggaattatgcaggcggaaaaacggaataagctccagtgatttactcttttgtgtcggataaacgtttccatcataactaaaagctagtttgcttccgctcagtttgtgaagagaatggcggatagaatcgggattcccgatcagcatcgggatctcctgcaaaggtgtttgccgaccgtgggcaatgtgaccgccgcggctgtcgtctgcatagattccgtcaaggttttctgttcctgtagaagttgcaagaacgatgggaccgtataagaaagcatagtaatctttcttgtcgggaatctgctccaggctgaccttcataggcagatggaaggtgatcatatctccttttttccacttacgccggattgggaggtacgtactggctcccgtctgtatgtcagataggtgtttcttaccgttgatggtgatttcatacccttttgagtttcctgcccattccggtatacgaatcattaatgtcaggttcttcttagcggctttgtctattcgtaaggtaactttttcatcatcggggaagagagtttcctgcgttaatgtaacgccttgttctttccagttcagttgtgaaggaataaaaagattgacgtaaagcgtatcttgttgatgcgcataaataaattcaccatacttggtatgattttccaagcctgaaccgacacagcaccacatcgatgtttccggttgcgagtatacccgataatgtccgggacgcatcggagtaaagtagacgaatccgcctttatccggttcttgtgatgacaggatatgattgtagagtgcacgttcataataatctacataacgtgggtccggtttgttggagttgtcaacgtctccggagttctgataaagcattttggtcagccggagcatgttgtaagtattgcaagtctccggtccctgaacgtcattcagcatagacgtaaagttgtccgatggatgaaaatgttcgcgtacgctgttcccgccgatacacacggaacggtgattgactacggtattccagaaaaaacgggctgcatgatcccattctgctgcatgattccagtctttgtcattctttgaaacttcggctacccgtttgtatccgattactttaggaatttgtgtgttggcatgcattccgtttaacctgtcttcgtttttgataagcgggtcgagaatgactttatgagagaaacggcgtgccagtttcaggtatttcttatcgcctgttatttccgctacatccgcaaacgtttcatttaagccgccgtgttcactgcggagcatatcctgcatttggttgtcgctaagaccggaagtaatatcaatcatccagtcggtaagatcaatcagcatctgacgtgccagatcgctgtgagcatacaggtaagcgtcccgcagtccggcatacgttttgtgtatattatagaggggtacccatttgccgtttaagctgaagcctccggcacgaatgtcacctgctttgatttctttccaaagttggaggctaccgggtgttcctccgataaatcctgtgccgacagcttgctgtgcacggtgtagttcgttgagcatatagttgagacggtggtatatcgccgtatctccggtggcggcatacatcatggaaagtgcggaaaggtaatgtccgccgatgtgaccgtccagtcctgtattctcccagttggtatagcttggggctttgggtgtcagtccggcttcgcgaaggaaaggagctgataatctgtccgggtcgagagctaagatataatgtaaatcagtctgttgagcttgcagaaaaggactgcttaataacttcacatcttgaagggaaaagtaagagacctgatggttcgtctgggcttttccgatggagatggatataataagggcaagtatgaacgaggtggttttcatgataatagcttccccctgaccccctccaaaaaggagagggaatgaggatatttatgttaatactaaattcagggaaagggggagaaaggtctccgtgaagccgcttatttgaatttgacggctgcttcttctataggcaaacctgccttgtagctttcgatgtatgtgttgaagccggctacatcttcgggtgtgggtgatacctcgacaccagcatcgctgacaaatacactttcatccaggaaatcggcaagagattgaccctttttattgtttaccaggtaagaacccagcagggcaattccccatgcaccgccttcaccggctgtttccataacagatatgggcgagttgatggctgctgcaagtactctttgaccgactcctttggttctgaacaatcctccgtgacctgtgattctgtcgactttgatcttttcttcgttgaacaagatgtcgttgccaatcttgagaactccgactgaggcgtacaaatgagcccgcataaagtttgcaaggttgaacttgtcattggccgaacgtacgaacaaaggtcttccctcggcaagtcccgtaacaggttcgcctgaaatgtagttgtaggagaggagaccaccgcaatcggtatcaccggtaagggcaatgttataaagtttgccatagagttcatccatatctacaggtatacccagaagttcctggtattctttgaacaggttgacccatgcgttaagatccgaagtacagttgttgcaatgtaccatggctacgaggcttccgtcgggagtggtgaccatgtcgatcatttcgtatggcttcgacaattctttttccaatacgatcatagagaaagaagaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccttccggtgtgaggacaccggcattttcaccagccgacaatactttgggcagaatgtcttccagtttccaactgtattctttcgaagcaatcagattgttgaatttggccaccatttcggcggaatagttgttggtagtcggatctatggggagcatacccgatgcgtcaccaatgcccaacaccttttcgcctgttatctgccaatgtacataacctgcaagagttgtcaggaacttgatgtctttgacgtgcgcttcgttgtccagaatagcctggtacaaatgagaaatgctccatctcaaagggatgttatagacaaataattcggataattctgccgcagcacggcctgtattggtatttctccaagtgcggaaaggcacgaggatttcttctttttcattgaaaggcatgtaaccatgcatcatggcgctgacaccgatggctgccagtgtttcgatctctgtgtcgtataatttcttcacgttggagcggaggtcggcgtagcaatcttgcagtccggaccagatggcatcaatgctgtaagtccaaagtccgttgaccagttgattttcccatgtgtggctgccttgagcgataggtttgttttcctggtcaatcagaacagcttttattcgtgtagaaccgagttctatgccaaggatagctttacctgtctcgatggttgattttgcatctaatttcatgttggaaaccgatattttaaggtataacaataagtgtggagaacaaaaactgagtctgctttcaaaaggcggaagtgtctttaattcgggttgaattaaaagtcgccagtatccatattgtgtgtgactaaaaagtcggtaccaatggagatggtaccgatttttttaagtggactcagtgattggtttttagcaaagcgctttgttcagcatataatatacttcattcatgcgcagttctttcttgaagcagctgatagtcgtatctttattgatatgtaccatttcgatgcctgcgatttctgcataatcttcccagtattctgctgtcaagtcgtatgagaagcaagagtggtgagttccaccggccagaatccatgcgcctgcgcctacttcgaggttaggcatcggaatccagagtgcggaagcaaccggcaatttcggaagtggtttcggttcgatacattctacatcgtttacgatcagacggaaacggttacccatatccactacagttgcggtgcagcctgttcctgtctttgaagtgaacacaagacgggcagtctggctcttacggatacctatgccgaggaagtgtacttccagacgaggcttgttagctgcgataagcggacagatctccaacatatgtgactgtaggatagaactgttggcaccatcaaagttcagtgtatagtcttcgaggaatgaacagcctttcggaagtccttgattcattacccatacagtacgataaagagcagccgatttccagtcaccttcagcaccgaatccgtagccttctgccatcaggcgttgagaagccagtcccggaatctgatcgaaatagctaccgtcagtctgacccagatcgtcaaagttggtagtgaatcctttggcgcctttcgctttgaggatagcacggagagcaagctcggctttggcagcattccatactttctgataagcttcggttgatttgtcttccagagaagcgtcatgatcgtagtcattgaagtaagtagctaccaaagcatctacatcagcatttttgatatctttgtgatattccatcagctcgcttgccgggcaataatctacatgatagcccatgcgttgttctgcttctaccttgtcaccatcggttacggctacattattcatctgatcgccgaaacggatgatcagcatatcctgagagtctgcccaacctgcgcaaacacgcatccagacagcaatcttatgcaatgtttcttcttctttccagtagcctaccactactttgcgacggatgcgcatacgggtacagatatgtccgaactcgcggtcgccgtgagctgactggttcagattcataaagtccatatccattgtatcccaaggaatttccttgttgaattgagtatgcaggtgcagcaatggtttctttaattgttgcagaccatgaatccacattttagcaggagagaaagtatgcatccaagtgatgacgcctacacatttgtcatcgttgttggctgctttgaatacagcttccacctctttagaagagttggccgttcctttgtatactactttaacaggaagtttgcccgattcattcagaccgttaaccatttcgttagagtgtgcgtctactgcgattactgcatcacctccgtacaagagctgtgctcctgttacgaaccatacttcatactgatcaaatacgttattcataatttattgaattgacaattgacaattgacaattgacaatgagagaatgtcgaaagtcaaatggcaattgcgggttattattaattgttttttgttgttttaattatagatattaataatttgtttatttctgtgctgtcattattgatgacaaccatctgagagcaaattaagtttaaacgccgcaaaagccgaggatcacgaatttgatctgtctctaataacatcaagcaaagataaaaaaaataatatatacttgtgtataaagggtagcttcccgaaggaggagaattgagatactaccgactttttagtcactccccagttatcggcagtcaaatgaaagcgtttgcttatttcatgatatgtttgccataattccatcctttgaggtcgtatagctctgcatccttacgaatcctttctttaaagtcttcataattccttttttcttgtggtgtccatccggcttcggcaacggcggcaagacgtggcaacatcaggtattcgagaacggaaggttcggtcacccattcggtccaaaagttggcttgtacacctttataataaggttgcaaggcagcatccacgtctttaagcggctgatagttataaacggcctccacagtttccgttccatgtccctgcgacatcggttccgtgggaagtttcgactgttttctgttgatataataaggtatttgcgggctcagtatggtgttcattccttgcttggcagcctgttttgcggcggcattagctccgatccatgccataatggtgatgtcattgccaaggatactggtatttccgtgaagcacttcgttccagaatataagttggcgttgttgatcggcaggtttggtggcaatgtaatcttttagttgtttgtagaaataaatctgcaagtctctgaagttggaagaacctatttcactcagcagcttcttgcattcgtcattcttttgccatttccttgtggggcattcgtcaccgcctaaatgaatataattgaatggaaacaattcagtgagttcatcaattacctctttggcaaactgcatcgctttcgggttggctacgttgattacatcagtagaaatcccttgttgtagccatacttcatgtttatcccttgggtcgcacgccaagaactccggataagctgcaacggctgcctgtgaatgtcccggaatgtctatttcgggaatgatttctataaatttcttctttgcatacgctacgatttctttgatatctttctgagtataaaagccgccataacgctcaccgtctggtttcacgtcaccgtatgcaagtactttgctgtttctccatgcgcctgtctccgtcagtttggggtatttctttatttcgattctccagccttgatcttctgtcagatgccagtggaaacgattcattttgtagatggccatcatgtcgatcactcgttttatctcatctttaccgaagaaatgtctgccttcgtccagcataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagaaacctgccggacgggaggcttcgatccggacttgttttttcgagacgttcagcttataagcttcagcgggaagttgtggattcaaatctaagataatccttgctttagcttctttttgagtagatgaaaccttgatgccggttgcttcttgcaattcctttttgaatgattcaaagaccatacggatgctgtctccctgataaggagtgactttggctttaagttggttgccaaactcaaagcggccgtcttttacggtaaggtgagccggttgtggggtgagagcgatttcttgtgctgtaagcatctcattgctaccgagtagcaatagcaggggtagaaaatgtttgattttcatggtaattgggggtatttaaataaaaagtataacagcggacgaagatagaaataataaatcagaaaagtatgtctttatgattattttgtttgctctttttgatttgtttgatctaggttcctcataaatttgcttaatttgataaattagtgtttctttgcaccatgatataagtcatgataactaacccccattattacaacttatgaaaaacaacaagatttatctgttgggagcctgcctcctgtgtgctgttactacctttgcgcagaatgttagtctgcaacctcctcctcaacaactcattgttcaaaacaagaccatcgatctgcctgctgtctatcagctgaatggcggggaagaagccaatccgcatgctgtaaaggtactgaaagaactgctttccggtaagcaaagcagcaagaaagggatgcttatttctattggtgagaaaggtgacaagagtgtgcgtaaatatagccgccagattcctgaccacaaagaaggctattacctgtctgtgaatgagaaggaaatcgtactggccggaaacgacgaacgaggtacttattacgctctgcaaacttttgcgcaattgctgaaagacggaaagctgcccgaagtagaaatcaaagattacccttctgtacggtatcggggagtggtagaagggttttacggaactccctggagccatcaggcacgcctcagccaactgaagttttacggtaaaaacaagatgaacacttatatatacggtccgaaagatgatccgtatcatagtgctcccaactggcgtttgccttatcccgacaaagaagctgcccagttgcaggaattggtggcggtagccaacgaaaatgaagttgactttgtatgggcgatccatccgggacaggatatcaaatggaataaggaagatcgtgatcttctgctcgctaaatttgagaagatgtatcagctcggtgtccgttcgttcgccgtattctttgatgatatctccggtgaaggtactaatccgcagaaacaagcggaactactgaactacattgatgagaaattcgcacaggtaaaaccggatataaaccaactggtgatgtgccctacggaatataataaaagctggtcgaaccctaatggcaattatctgactacgctgggcgataaactcaatccttccattcagatcatgtggacgggagaccgtgtcatttccgatattacccgtgacggcatttcatggattaacgaacgaatcaagcgtccggcttatatctggtggaacttcccggtgtccgattatgtgcgcgatcatctgcttctcggtcctgtgtatggcaacgatactacgattgccaaagagatgtcgggctttgtaaccaatccgatggaacatgccgaatcgtcaaagatagcgatttatagtgtggcaagttatgcctggaatcctgccaagtatgatacatggcagacgtggaaggatgcgatccgtaccattctgccaagtgcagcggaagaacttgaatgctttgcaatgcacaattccgacttgggacctaacggacatggataccgccgcgaagaatctatggatatccaaccggctgccgaacgtttcctgaaagcgttcaaagaaggcaaaaattacgataaggcagatttcgagactcttcaatatacgttcgaacgtatgaaagaatccgccgatatcctgttgatgaatacggagaacaaaccgttgattgtggaaatcactccttgggtgcatcagtttaaactgacggctgaaatgggagaagaagtgctgaagatggtagaaggccggaatgaatcttattttctgcggaaatacaatcatgtgaaggctttgcagcaacagatgttctatatcgatcagacgagtaatcagaatccttatcaaccgggagtaaagacagctacgcgagtgataaaaccattaattgaccggacttttgccacagttgtgaaattcttcaatcaaaagtttaatgctcatctggatgccactaccgattatatgccgcataagatgatcagtaatgtggagcagatcaagaacctgccgttgcaggtgaaagcgaaccgtgtactcatttctcctgccaatgaagttgtgaaatgggcggctggaaacagtgttgaaatagaactggatgctatctatccgggagagaatattcagataaactttggtaaggatgctccttgtacatggggacgccttgaaatctctacggacggcaaggaatggaaaacggtggatctgaagcagaaagaaagcagattgtcggccggtttgcagaaagctcctgtgaagtttgtccgcttcacgaatgtgagtgatgaagaacagcaggtctatttgcgccagtttgttctgactatagagaagaaataagaatgattatataggctgactaaaaagtctgaactacccacaattcccctccttcccgaaggaggagagttggaagttaccaccgactttttagtcagcctttttttgatttacgatattcccgcggtgacattcccatgatcttactgaataggcgggaaaaataataagtatcttcaatacctattttatagcatatctgatttatcttcatatcggtggtatccagcaacaggcaggcctgctgcatctttagcagattaaagtaagtaagcggactgtgtcccgtttgctttttgaacaacatggagaagtgcgacggagaatatccgatttgtgttgatatctcttccagactcagatgtttctccatattctctttcatgtagtggatggcaacgttcactattccctcgtcttctgcctcattggtgcctgcattacgatattgctggacatagcgtaacgttcccaaataaaagtgaaacatagaaaacgcataacgcaggttctcgttgctataaccatttttgagtgtattgaatatctcttcaaacaggttgatccgcgtactgatgcgggagtgttgttcggactgaatatccatcggacggttggcgtctttggcatagaacggagcaagaatacctttgaagtgaatccagtaaatagtccatggcgtcgatttgttggaagcataagaatgcgggactcctgccggaagaataaaatactgattggcggagacggtatattcctggtctccgatccggtaagatccggcaccatcaatacaatagatgaagacatattgattgatgggctctttccgttcccgaaaatgatgcttggctttgggataatatccgatgtcagtgatatgcagcatggaggtcagcgggtcctcttccatcttatcaacgatgatgcggggcaatactaaggctctttccccggtaaatccatcttttagttttaccatagtacataattggttattctgcgcaaatatataataatgtatgcgatctgtcaaataatacattaaaaataagattgtccatctttataaaatgaaattctattttttgtgctttggatacgcattagaatgataataacagatgttcttttttctaattgtccccctctttcttgccttgttttataagccgattgcctatctttgcggcaggtttttaaataataaatcaaaaagagaaaactactttatgaaacacatttcgaacttcctcagatcaaaaagctggaacgtatttttgtttttatatcttgctcttcctttgtttgcgcaaaaggaatataagatcgatcaggtatctgttgttaatgtaggcgatggcagactgttgtttcaggaactgaaaacggaaaaagcattgaatggcgaacatcgcatcatagatggttatcattccgcctatgtgctggcatcttttaaagatggtttttatgatggcggatacaaagaatatgtggacaatatattaataacggaaggaagttataaagaagggcggaaggatggcctcttcaagattaactccaagtttgacggtaagctgaaagaagaaaagtcctataaggaaggtaagctggacggtacgagcaaaagttactttactaccggaaaagtggaaagtgaaagaaacttccggatggggaaagagcacgggaagcaactgtcgtacgaatctgacggtactttgcggaaagagcataattacaaggacgggaagcaggtaggcaaacagtatacttttctgaaaggtacatatgatttgtatgagaccgtttatttcaatgaagaaggtttgcaggacggtgaatattcgtccgtgtttacgtttggctcgccacgtatactgggtagttataagaatggaaagaagaatggtcggtggactacttttgctgaaagcggagatacgctgatgattgaaacctatctggatggaaaagaagatggactccatgtctcatttgccaacggaagtggggtaaggcagaaagaatattatatgaagaacgatcgtaaagacggtttataccgtgaatataatctggaaaatggtgaattgagatatgaagctacctatcaggccggcagattgcatggcaaggaacgacggctgatagtgagcaaccgctttgattattgggaaacttctacctatgtgaacggaaggcagaacggaccgttcgaagctcgttatgtaaagaatgaccagcttcgtgaatgtggggaatataagaatggtcgccgtgtaggacgatggaaacgctacactattgatggtaaactggaaaaggaatgggatgaaaactaaccggtagatgaaaggtcagggcataaaaaaaggagcaacgccttgctccaacctttgttaaccttaaatctaatactatgaaaaacacagtgcaaagatacggacttctgtgaaatctgcaaattatccaagtaaaacgctatgttttataacattgattaagtgtttgttttacgctttatacttttgttaatactttccgatggtctgaaagaggactgctttccttctttttagaataataaatagctgaagttagagaactttacagtattatttcttatttttgttcttaattggattacagaaagaactatgaaatgatgagatggatgaagacgatgagatatctgaagtggatgctggtgctgtttggtttaatcgggatgacggcttgccggcaggatacaccccattttcgtattggggtggctcaatgcagcgatgattcatggcgacataagatgaatgatgagattcttcgggaagcaatgttttataatggcgtttcggtggaaatccgttcggcaggagatgataacagtaagcaggcggaagatgtccattattttatggacgaaggagtcgatctgctgattatttccgctaacgaagctgctcctatgactccgattgtagaagaagcttatcagaaaggcatccccgttattcttgtagaccggaagattctttcggataaatatactgcctatatcggagccgataattatgaaatcggtcgttcggtaggaaactatattgcctccagtctgaaagggaagggaaatatagtagaactgacaggattgagcggttcgactcctgcaatggaacggcatcagggatttatggctgccatcagtaaattcccggatataaagctgattgataaagcggatgctgcgtgggaacgtggtccggcagagatagaaatggatagtatgcttcggaggcatcctaagattgatgctgtgtatgcccataatgaccgtatcgctccgggtgcctatcaggcagcaaagatggcagggcgggagaaggaaatgatttttgtcggcatagatgccttgccgggtaagggaaacggactggaactggttttggacagtgtgctggatgccacctttatctatccgaccaatggcgataaggtactgcaactggctatggacattctggagaagaaaccctatcccaaagaaacggtgatgaataccgctgttgtggaccgtaccaacgcacacgtcatgcagttgcagactacacacatctccgaactcgataaaaagattgaaacgctcaacggacgtatcggtggatacctctctcaggtagctacacaacaggtcgttttatacggcagtctgattatccttttattggtagccggcttattattggtcgtttataaatcactccgctctaagaatcgcttgaataaagagctttttaagcagaagcagcaattggaagagcagcgtgacaaactggaagaacagcgtgaccaattgatacagctctctcatcaactggaagaagctacccatgccaagctggtctttttcaccaatatttctcacgacttccgtactccgttgacattggttgccgacccggtagaacatttattggcggacaagacattgagtggagatcagcaccggatgctcatgctgattcagcgaaatgtgaatatccttttgcgcctggtcaatcagattttggatttccgtaaatatgaaaacggcaagatggaatatactccggttacggtggatgtcctttcttctttcgaaggatggaatgagtcttttcaggcggcagcccgtaagaagcatatccatttttcttttgatagtatgccggatacggattatcatacactggcagacatggagaagctggaacgtatttatttcaatctcctgtccaatgcctttaagtttacaccggaaaacgggaaaatagccatccgtctgtcttcccttagtaaagaggacaagcgatggatacgtttcacggtggcaaataccggttccatgatttctgccgaacatatccgcaatgtattcgaccgtttctataagattgatatgcaccataccggttcgggaatcggactggcattggtaaaagccttcgtagaaatgcacggtggtatgatctccgtagagagcgatgagaaacagggcacggtctttaccgttgaactgcctgtacagtcttgtgaggctgttgctgccgaaccggataccacccttgtttctgcggattcccgtacaacagatgttctattggcagaagaggaagaactggaaaaaggatatgactcttccaaaccgtccgtactgattattgatgataatgaggatatccgttcgtatgtccatacgctgttgcatacagactatacggtgattgaagcggcagacggctccgaaggaatccgtaaggctatgaagtatgttccggacctgatcatttctgatgtgatgatgccgggcattgatggcattgaatgttgccgccggctgaaaagtgagttacagacctgtcatattccggttattctgctgacagcgtgttcactggacgaacagcgtattcagggatatgacggtggtgcggattcttatatttcaaagccgttcagttcacagctgttgctggcacgtgtccgcaatctgatcgattctcaccgtcgtctgaaacagttctttggtgacgggcagacattggcaaaagaagatgtctgcgatatggacaaggattttgtagaaagattcaagtcattgattgaagagaaaatgggagactccggtttgaatgtggaggacttgggcaaagacatgggactaagccgtgtgcagctttatcgcaagattaaatcattgactaactactctccgaatgaattgctccgtatcgcccgtttgaagaaggcagcttctttgcttgcttcttcggacatgaccgtagcggagattggttatgaagtcggtttcagttcaccttcttatttcgccaagtgctataaagagcagtttggagagagcccgacagatttcctgaaaaggaaaggatgatttcattgatatcgtaaagagggatatatgaaagattataaagtagataaagagagcttttccgaatcctttcggaaggaagtgtacgaagtcgtatcccagatacctgtgggaaaagtatctacttatggaggtattgctttgctgttgggggcaccccaatgctcgcggatggtgggacgtgcattgaaagaagtgccggatgaattatccattccctgccatagagttgtaaattccaccggaaggctggtgcccggttgggtggaacaaaaacaactcttgctggcagaagaagtttctttcaaagctaacggatgcgttaatctgaaagaacatttgtggcacgtggatgaatgaaggatgcaaggaaggtaagccatatcatccgtatccatacaataaagaaaacccatacatgaagccataaggtcctggtaatgaaatctctgatgggtacagggacgaatatgtcgataggaacgatacataacagcacaaaacagcaccaaaatagaatcttgtctgttgcggtacgtgttggtctgctccaataccagagcatgaaacctgccaatgcgataatataggtatgcttctcggcggagtcactcagtaatactacccagcccatgagaatgcccaaagcctgggcacggaaggcaaaagacgaccatttgcggaaattccccaaaaagagcagagtcagcaagccgagcattcctatctgaagtgcacggaagtgtggcaatgtccatgctgcaatggggcgggcatagaaaaatgaatcataagctccggcggactgatgaacagcaagactatggcaccattcttcataataggggagcaaatctgcaggagctatttttattaacggtaatgcaagcaatacaatgcccattgtaacggcatagccaaagttacgccatacgtgaggatagcacagcaacaatgccagttcgaaaattccatatactttggtacatcccgaaatcatgattaacagaacagccagaaatccacggtctttttccaataacgtataggcgaataagaataaataggctaccgttatgttatactgaaatgaaagtaaactttgtcctaaaatcagtaacagaaaaaggaacatacggcatttctgctgctgggtgaattgttggggcagcgtgaagatcgccataaagaacagcgaataattgaatagattccacgcgaaaggtcccagccatgcaggcagatacgcaaacggagcgaacaataccgtgaaaactggagaataaaggaagtagcgtccgtgagcttctacaaattcagttgtgtatgggctgatgccttgccagaagaattgagtagcgtccgagaagaccataaagttttgatgccgtcctcgtataaattcgagcagagtcactataaaagcgagcaggaaacctatcatgtagagattccgccggctatagaaaaacggcattttggggttctttttactaaggaactgtacttggcttttgtcgtctagtgtggcagtacctgtttgtttttcttttgttgtgtaatgacaattatccttccccaggaaaattgtaatagccctgttgaacatataaatctagtttagttattgacgccaaatatacggtgtttaagtgaaatattcaaacttattttatatttatctgccggtttgttctattttgctgagtgataggggaatattacccggaaactttccatatcattacaaataaagccctctgtatgccccggattttgaatataatttgtatgtttaatccgttttttgtatctttgtgccagcaagatactggaacaggctgtttttatacataaaaatgctattttttgctattcgttgaaaggattatcttatcaaattctattccttttttaattactcagtctgtcaataatcattttattaattatttcgggattcattgttatttgtcccttatttaaatcagaactttatacgatataaagaaagattcctgttatcgtttgttcttgtcttgctgtgtatattattttaataacctaaaccattttattgtatgagtaaaatagaaattaaagatctctatctggtttttggcaatgagaagcagaaggctttgaagatgttgaaagaaggtaaaacaaaaagtgaaatattgaaagcgaccggatgtacagttgcggtgaaagatgcgaatctttccattaatgaaggcgaaatattcgtcattatggggctgtccggtagtggaaagtccactttactccgctgcatcaaccgtttgatacgccctacttccggagaagtgattatcaatggaacagacatagccaaagtgtcggataaggaactgttgcagattcgccggaaagaactggctatggtctttcagaacttcggtctgcttcctcaccgttctgtcttgcataatatagctttcgggctcgaactacagggagtaaaaaagggagaacgggagcagaaagcgatggaaagtatgcaactggtggggctgaaaggctacgagaatcagatggtaagtgaactgtcgggtgggatgcagcagcgtgtcgggctggcgcgggctttggccaataatcccgaagtcctgttgatggatgaggccttctcggcactcgatcctttgatccgtgtgcagatgcaggatgaactgctgactttgcagtcgaagatgaaaaaaacgattgtctttattactcacgacctgagtgaagcgattaaattgggtgaccggattgctatcatgaaggatggagaaattgtacaaatcggtacatcggaagaaatcctgaccgaacctgccaacgcttatgtagaacgatttgtggagaatgtagatcgaagcaagattataacagcttcctctgttatggtagataaacccatagtggcacgtttgaagaaagaaggcccggaggtgctgatccgtaagatgcgcgaacggaatctgaccgttcttccggtagtcgattccaataatctgttagtaggagaggtgcggttgaatgacttgctgaaactacgaaaagagcaaatccgctccatcgagtccgtagtaaggcatgaagttcattcagtgctgggtgatacggtgctggaagatattcttccgttgatgacaaaaacgaactcgccaatctgggtcgtaaatgagaatcgggagtttgaaggcgtagtgccactttcctcattgatcatcgaagtaacgggaaaagataaagaagaaattaatgaaatcattcaaaacgcaatagaattatgataaatatcggacaatatatagagactgccattaattggctcacagaacattttgcttccttttttgatgctctcagcatggggatcggaggattcatagacggttttcagcacgtactgtttggaatacctttttatatcacaattgcagtgctggctgcgctcgcctggtttaagtcgggtaaggggacagccgtatttaccctcttgggtttattgcttatttacggcatgggcttttgggaagaaacgatgcagacattggcattggtactttcttccacttgtctggcattgcttttaggcgttccgttgggaatctggactgccaacagtgatcgttgtaacaagataatgcgccctgtcctcgactttatgcagacaatgcctgcctttgtctatctgattcctgccgttctattcttcggattgggaactgtgccgggagcttttgccaccatcatctttgcaatgcctcctgtggttcgtctgaccggtctgggcattcgtcaggttcctaaaaacgtagtagaagcctcccgctcttttggagctactccctggcagcttctttataaggtgcaattgcctttggcgttgcctactattctgacgggaatcaaccagacgatcatgatgtcactttcgatggtagtgattgctgccatgatttctgccggaggattgggagaaatcgtgctgaaaggtatcacccaaatgaaaatcggactcggatttgaaggcggtatcgcagtcgtgatattggcgatcgtgctggaccgcatcactcagggtatggcagataacagaaaaagtaaaaagaaataagaatcacaccaaagaaaggaataatcaatgaataagataaaaatgattgcggcaatgtttattgccggcatactcttaaccttcgtttcctgcggagacaacggaaagagtaagaagataagtatcgcttatgccaactggtcggaaggtattgcaatgacaaaccttgccaaagcgatttttgaagatcaggggtacgatgtaaagttgctgaatgccgaccttgcacctatatttacctctatctcccgtaagaaagcagacgtatttatggatgtctggatgcctgtcactatggaagattatatgaaacaatacggggataaactcgaagttatcggggatatttatgatggtgcccgtatcgggctggtggttccggattacgttacgatcaactcaatcgaagaactgaacgcggaaaaggaacgtttctccggtcagattgtcggtattgatgccggagccggtattatgaaagctaccgatcaggccatcaaagactatggattggattataaactgatgacttcgagcggacctgccatgactgcttccctaaagaaagcgattgataagaaagactggattgtcgtgacgggatggacgcctcactggatgttcgaccgtttcaagctgaaagttcttcaggacccgaagctgatatatggaaatacggaatccattcataccatagcatggaaaggttttagcgagaaagacccttttgctgccgaacttttgggcaacattcgtctgacagatgcggaaatcagctccttaatgactgctctggaagaggcgcagacaacggaaagacaggctgcccgtcaatggatggaagaacatcaggaactggtgaacagttggattcctgagaaagattgatatgcaaacactacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagctctgaaagtcagtatcaaaccgataatccaaataacaaatccgatcatatctttagagttttaatgaatatcttcgtgagaagtaatcgttacttctaagatataaacaaaaaaggcaggaatctgtttccaggattcctgccttttattatgtacaaagtatttctacttattattcagctgtatcagctccccagttttctctggcaagacgtttgtagctgttgtaacgccatttagcgttttcttcagcagctttaaacagttcttcagcttcagcaggatattgtttcattacagaagcgtaacgaacttcacccttcaagaaaccttggaagtcttcccagttaggttctttgctatccagttggaacggattcttgccttcttcttccaaagcagggttgtaacgccacaagtgccagtaaccgcacttaacagccttttcttcttcttcctggctcttacccataccggctttcagaccgtggttgatacatggagcgtaagcgatgatcagtgatggtcccggatatgcttcagcttcacggatagctttcagagtctgagcctggtcagcacccatagcaatctgagcaacatatacataaccgtaagtagtagccatcagaccgaggtctttcttacgtacacgcttacctgcagcagcaaacttagcgatagcgcctaccggagtagctttagaagactgaccacctgtgttagagtaaacctcagtatccaatacaaggatgttaacgtccttaccggaagcgattacatggtcaagaccaccgtaaccgatatcataagaagcaccgtcaccaccgatgatccattggctgcgtttaacaagatattgttgcagatcagcgatttgcttgcagtggttgcatttatctttagcagcttctaccatcggaatgatcttttcggccagttccttagtcttttctgcatccagcatattgttgatccattcagcaaatacttctttgtattcagccgggcagcaatcagaagcgatagcttcgttcattactttcaccagacgggcacgcatcttttcgttagccagttccatacccagaccaaattcacagaagtcttcgaacaaggagttagcccatgcaggaccgtgacccttttcgttcatagtgtacggagtagaaggaactgaaccggagtagatagaagaacatcctgtagcgttagcaaccatttcacggtcaccgaacaactgagaaatcagtttcacgtacggagtttcaccacaaccggagcaagcgcctgagaactcaaacaacggagttgcgaactgagagttcttcacgttagccttgatgtctaccaggtgttgtttgctcttcacgttttcagcgcagtaagtccagttatcagcttcggccaactggctttcaaggtgtttcatggtcaatgccttgccacccttcttcggattacccggacagatgtcggcacagttaccgcaacccagacaatcgagaacgtctacctgaatacggaatgtcataccatcgaatgctttacctacagctttcagttgctcgaacttagcacccttctgctcttcagcatcgagtacgaacggacggatagaagcgtgaggacaaacgtaagcacacttgttacactgaatacagttttcagcattccattcgggaacgaatgcagctacaccacgtttttcgtatttggaagtaccttgataccaagtaccgtcttcgatacccttgaatgcagataccggcagcaagtcaccgtcctgtgcattgatcggacgaactacttcgttgatgaaagcaggatcattgttttctgcttttgcatcatccggcaggttagcccaagcaggatcgacagtcagagtcttgtattcaccaccgcggtctacagcagcgtagttcttgttaacaacgtcttcacccttcttgccgtaagacttaacgatgaatttcttcatctgttcaacagcttgatctacagggattacgcctgtgatacggaagaatgcagactgaaggattgtattggtacggttgcccaaaccaatttccattgcaatctgagttgcgttgatatagtatacagagatgttgttctgtgcaaagtatttcttcaccttgttaggcaggttcttagccagttcttcgccttcccagatggtattcagcaagaaagaaccgttcttacgcaaaccacgtgttacgtcgtacatgtgcaggtaagcctgaacgtgacaagcaacgaagttcggagtatttaccaagtaagtagaacggatcggagtatcaccgaaacgcaagtgagaacaagtgaaaccacccgacttcttggagtcgtaagagaagtaagcctgacagtgtttgtcggtgttgtcaccgataatcttaacagagttcttgttggcacctacagtaccgtcagcacccagaccgtagaatttagcttcgaacataccttcaccgcccagagcgatttcttctttctgaggaagagaagtgaacgtaacgtcgtctacgataccgatagtgaagtggttcttcggcattggcatagccaagttttcgaatacagagatgatctgtgccggagttgtatcttttgaacccagaccgtagcgaccgccaacgataacaggagcattttctgcgccatagaagcagtctttaacgtcaaggtaaagaggttcgccgttagcacccggttcttttgtacggtcaagcactgcgatgctctttgcagtcttgggtacagcagccaggaagtgtttagcagagaacggacgatacaagtgtacggcaaccatacctactttttcgccgtttgctaccaagtggtcgatagcttcgcgggcagcttcagttacagaacccattgcgataattacgcgttctgcatcttctgcaccgtagtaatcgaacaaaccgtatttgcggcctgtgatcttggaaatttcgttcatgtattcttctacgatagcaggaactgcttcatagtagttattgcatgattcacgatgttggaagaagtggtcggggttttcagccataccacgggcaaccggcttcatcggattcagtgcacgggcacggaattcagccaaagcttcctggtcgatcagcggagcgaggtcgtcgttttccaacatttcgatcttctggatttcgtgagaagtacggaaaccatcgaagaagttcatgaacggaacgcgtgatttgatagtagccagatgagcaacacctgccaaatccataacttcctgtacagaaccttctgccaacatagcgaagccggtttgacgagctgacattacgtcctgatggtcaccgaagatacacaatgcgtgagaagccagtgtacgagcagaaacgtggaatacacaaggcaagaattcaccggcaatcttgtacatgttagggatcatcaaaagaagaccctgagaagcagtgtaagtagtagtcaatgcaccagcctgaagagaaccgtgaactgcaccggcagcaccaccttcagattgcatttcctgtaccaatactgtttcgccgaagatgttcttacgtcctgcggcagcccattcgtctacgtactcagccatagtcgaagaaggagtgatggggtagatagctgctacttcagagaacatatacgagatatgtgctgcagcttggttaccatcacatgtgatgaatttcttctgtttagtcataactaaattaaatatttaagtaaataaatctttttagtataagaatccgaacatccaaagaggtatttggttgccgcggcctatctcagccttttgcaacgcatacgtcacgtccgggttattctttatttttgtaccttccgcacaaattttgaacggcatcacttcgtctaccatgaaagagacgtttttatctcctttatgtaccttatggtctttccataaagtgttaacgaagaacgtgtcgagtacatcctgttcttccactttcaccggataaatggagtacatcaggttagagttgtgcatcataatctttgacggtttctttgggaattcttctcctttcgggtaaaccagattaatcagacgcgcgtctgccagatacttgatatagttcattaccgtagcgcgggatgtctgtacgtcacttgccagttggctcacgttcggagctttcggtccgtccacagccaacaaatatagtaatttttttatctttgaaagatatttcagctcaatttgtttgatcagcaagatatccacttctaccatcatgttcattgttttcagcagattctccgagaaattacgtttttcaaggaagaaagggtagaaaccatgatgcaggtaatcctgaaaataatccagcggtcgtactttggaaagtactcctttggctatctgttcatgtgtactgaggatttcttcgaggctgtatgcccggaatttcattcctgtctgcaggttcagaaattcacggaaagagaatccgcgcaggttataacttttcgcaatgtcacgcaattcgaggttttcctctttgagtcgcatgacggaagaaccggtgaagacaatcttcaggctggggaaacggtcatagcacattcgtagctctttgctccattcgggatgtttgaacacctggtcgatcagcagtacttttccgccacgtttctgaaactcgttggcgaagtcaacaaggctgtgaccggagaaataaaagttgttcatattgatgaacagacaggaacggtcggtgccgaatttctctttggcgtactgcaggaggaaagtggtttttcctacgccacgtgtccctttgataccaatcagacggtcactccagtcgatctcgtccataagatcgcggcgaacgggggcattggtgtgctcaacgaggtaggcgtgtgtgcgatagaatgattccatttcgtttctttgtttttcggctggcaaatatagtgctttttttaggatttgcaaagtagagatagcaaaaatgtgctttaatttataagtttctctttattgtgtaagttcctgattatttcctgtatatatttgcagaataatgtgttgaatccatctttgacatgacgaaaagacctgtttatatattcaatccggagcatgatatggcgttggcaagcggtgagacgaactatatggcgccggcttccgcccgacagatggcgagtgacctggcgttgcttcctatgtggtatgccgaagcgggaagtgcggtgcttgcaccgtctgcttataatgcggacttcctgaaaacaaagagtgaacttttgggcatggatgtggccttgttgacggaaccggaagtggctgacggtaaagaccggaagttctctccgtgggggtgggaccctgctttgcggaagcgtttgatgacattgggggcagatcagacggagctgccttctgcggattatatgaatattctgagagagcattcgcatcgtctgcaggcggtaaagttgttgcctgggttgcggttgaatgaatacttctgtggagaatctttttatttgagtactttggcggagtgcagtgcgttcgtcgaagggcgggaagcgtgcttgttaaaagctccgctttccggaagcgggaaaggattgaattggtgtaaaggcatatttactacttttatttccggttggtgtgcccgtgtcgctgcttctcagggtggggtggtaggcgaacctatatataataaggtggaagatttcgctatggagttttatgctgacgggagaggaagggttgtttttgccggatattcggtcttccacacgggtgggagtgggatgtatgcagggaatgacttgctgtctgacgagaagattctgcagaaactatcggcttatgtgccacaagaagaatttatcaggctgcggactcgtttggaagaagaattgtcagctttgttcggtggcttttatcatggatacttgggagtggatatgatgatttgtcattttccggatgaagcgcctgtttaccggattcatccttgtgtcgaaattaatctgcgaatgaatatgggggtggtggcatggctcttgacggatcgttatttggctgcggatgcggaaggagtttttcggattgattattatcctttagccggtcaggctttggaggaacatcggcagatgtcggcttcgttccctttgtccgtagagaataatcgggtgtgtgccggatatttgccgttagtaccggtgacgcctcaaagccggtatcgtgcgtttcttttgcttactctcccccagtgaaaaagatagtgcttttgctctcatgctctaacagttcgtctgtatccctttattcatcgatgttttagctgttagagatccagtggtagcagagtgagagcaaggacttgctctcactctgcatcgtcctgataaataccgtttttactgtgttattctttgatttacaggatgttaatatctgatatctcaactgttaacgtttgatttctcagatattaataattgagaaatcaagtattaaggactgataatttatgtattattgactgatatatgatttaatgttttcagagagagcagtactattgaagtagctgatgcgttcaatgtgattggaacatgcggttaagtcaatcaaatcaacagtagtttcagatagtttcgagcgtttggaactaaagtttcaagcgtatgaaactctagtttctcaccgatgaaactacagtttcacaccgatgaaactctggtttcaagcaatggaaactctttgaagatactgctaaattggaattggtgaacatcggaaaagtcatattgtggtaatactgtctgaaatgcctacttatctccatttatgggtgcactctcattcccgcaacggtcgatagccgttactgcaaaatacttcttggcattccaaggctggatgggtgcataaatgtaacttgtttcacgaatactttgtgcgacaatattttccgctttctttgtatctaccggatattcattggaagcataaatcacgtacatcggtttattccgttggtcattatccgtcgctggttgccagttcaattcggtatatccgttgtcgatggacgtaactttgagtgctgagggggcagacggcggaacgttatccaaccatgtcatcgggggctgtaatgccggataggcatagaagttctcaatcagttcgtcataaattccctgagtattgtccatcagatacttgacacggtaatgcccttctcctgccattttctgattacggatgaaattaatctgacgatccacttcgtcgcgtgtccacttcccttcgtcgggatggaggaaatagatgcccagccccggaataacctgtcgtccgttgctctgttcctgccagtcgagcgcgaaaggatagaaactgtttccctgaaaatacatcatgggatatatctgatcctgaataccttctccgagccatccttgcgggtcttgataaacggtatagaacgcattccaaccacgggaagaatagcgggaagtatctctgtattttcctacagggcaagtacttacctttacccacggcttcattgctttcacacctttatatatgtaccggacgatttcggaaatgttatcccgtcgccattgatccaaagtacgtcctttgctgtaacggcggaaatcgtatttgtcggggaatagaggagcattctccggatagcgcaggtagtcgaaatgcactccgtctatatcatagcgctccaccacttcacgaacgagtctcatgagatactctttcgtagcaggatgccccggattaaggaaatattcatttttataaggcacgcatatatctttcactcgcttggtgacagattgtttgccgagagaagcgacgtgctttttgttgcctagcggaatagtcaccatccacgcatgacattccatcccccgcttgtggcattccccaatcgcaaaagccaacggatcatatcccggatttcctccgacttttccggtcaggatagaattgaacggttcgatggaagaaggatacagcacatctccgcgtgtacgggtctgaaacaggacagtattgaagttggcagctttcagtttatcaaggatatccaccaattcttccttttgcttgcggatgccctgaggagtcgtggcccgtgtacggggccagtccagaccatatacagccgtaatccatgctgcacgaacttcgtgcttgggttgcgccttagccggaaggataagaaacaaaagtgaaagaatgaaaatagttcggtgcatattattcccttttagatgctaaatctctgcaaagctagcaaaaatgtccgtaaattgattattccttttttatttaatgctatttgacagaaaattactgattctcttttagtggtatctgcattcttagccgtcttttaataaggtacgaaatataaaatattaatataacaagataataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgactgcccagacgggaaagattagagttgctactgttggaaacagtatcaccgggggaacgaatgattatggttattacgcgatgcctctggctgaaatgctcggtgatgattatgaagttaccaaatttggtaaaggctcttccggggtatttataaaattaagagaagatgcgactactcccgaaaatcctaatgaatatcaattcgcttacattaattctgagcaatgcgcagcggcacttgagtataaacctaatattgtcattattaagtttggtgcaaatgatgccaacaagaagaatttcgaaaaatatggtaaagagacttttaaagcagactataagaagttgatcgctaaattccaggctctttcgactaaaccggatatttatatttgtacgcctccgccgatgtattatggcgatgggggatttcttggttcatttgatgacaatgtagcaaagaattatattcagcctgccgtaagagagattgcggaggaacttaatctggtctgtgtagatctgtataatcccttgaagggacatccggaatttatgccgggtggcaacgattgggtgcatcccgaccatagagggcattatattatagcgaaggaagtgtataaggcgataacgggtgaattcgttatgaaccccggtgggataacagtggctgcttcggatatttctctttcgggttcgaaggcgaagatgaagaatggtgctattgaaaaagcgaagaacggtacgagattgtcattcgatgtacattttggctcattgcctacgtatgagaaagtagaggttgacgtgcaattgaataaaaagaaatcgggatacttggatttctatctggatactgaaacaattccttttgcctcggttgatgtttcgggtgccgactctaagaatttcactacacaatctgctcttttcgaccgtcggataaaaggcaaacataaagtgactgtacaatggagaggacaggatgccaaactgaaatcagtaactatcaaggaaaaatatatgccttatgtaaccgataatgtatctcaggtctatttggtaaacaaggcaaccggtatggtactggattgtaatccggattcgaaagtgatttctgccgcaaaatatgattcggaaaagaagtcccagttgttttgtatcgagaatttgacgtatcatatcctccgtgtcagaaatatagcgaccaaccttcatgtaatgaataatggagataaagtgattgtgggtaagccgggtgatgactggcgagtgcatgatcctaaatatgcattgttcctgacacctacggatgatgaaggctattattcattggggctgtctcctgaagcaagaattggtttgtcttctgccaacagcacagaggtggtaggcaatagaagcggccaaattgaagacttggataaatggaaaatcgtgacagctgatgaaatgaagaagcagtaattcagaccttggtgtatatattggattatctatattagcattgaaaagaaaggaggttgtatctgaacctttgccggaagaacaagaaacaaaagtgaaagaatgaaaatagttcggtgcatattctttattttttgttttaaatccctgcaaagttagcaaaagtgtcggtattgttgggctgtttcgtgagattatgttacatttgcgacagttaaaaaacaacacgccatgattacatttaccctgtgcctgctggcgttgatagcaggctatttcacgtatggacgcctgatggagcgcgtctttggtccggacgaccgtaaaacaccggctcttaccaaagccgacggagtagactatattccgttgcctacttggaaaatattcatgattcaattccttaatatcgccggactgggtccgatattcggtgcgattatgggagcgaagttcggtacttcttcttatttatggattgtattgggaagtatttttgcaggcgctgttcatgattactttgccggaatgctttctttacgtcatgggggagagagtcttcccgaaatcataggccgttatctgggactgactaccaaacagataatgcgtggatttactgttcttctgatgattctcgtcggttccgtctttgtagccggacctgccggactattggccaaactgactccggaaagtctggacgctactttttggattgtcgtggtcttcctatattatattctggctaccctgcttccggtcgataagatcatcggtaaaatatatccgttgtttgcagtagccttgctgtttatggcagtcggtatcctggtaatgctttatgtcaatcaccctgttttgcccgaactatgggacggcttgcagaataccaatccggatgccagtgaactgccgatcttcccgattatgtttgtgagtatcgcctgtggtgccatatccggtttccatgccacgcagagtcctttaatggcccgctgcatgacttcggaacgtcatggacgtccggttttctatggtgcaatgattaccgaaggcatcgttgctttgatatgggcggcagccgctacttatttcttccatgaaaatggaatggaagaaagtaatgcttccgtgatagtagacgctatcactaaagactggctgggagctatcggtggagtgctcgccattcttggagtaattgcggctcccattacttcgggagataccgctttccgttccgcccgtctgattgtggcggactttctgggactggaacaaaaaagtatgcgccgtcgtttatacatttgtattccgatgttcgcagtagctatcggtctgcttctttatagcttgcgtgacgcggacggatttaacatgatctggcgttactttgcctgggccaaccagacattggcggtgttcaccctctgggctatcacagtctaccttgtggtagccaaaaagccttattggattacgctgatccccgccttatttatgacgagtgtttgttctacttatatatgtattgctcccgaagggctgggactctcgcatatagtttcctactgcatcggtataggatgcgtagtggtagctattgcctggttctttatctggctgggaaaacaaaaaactagaaaactatcagaatgaagaaaataaaaaaatcgacaggagttgctatcgcattccttatttatgtatcagtaacggcagcctatttgttacctcgcaacacggaagtcggccagacggagaagattcttacggtggtaggttcttacgtcatcgtactcttgctttggctcgtgctccggaagaaggaacaaatgcgtgaacgccgtaaaaaagacgaacaatctattcacttaaaaaagtaaatttatgaagaaattagctttagctatttgtctgctggtggtatcaatagctgcccaggcacaatttgagaaaggaaaaatgattcttaatccttctgtaacgggattggatttttcgtatagtaaaaacgataaggcgaagtttggtattggtgcgcaagccggtacattccttgccgacggtatcgcattgatggttaatgtcggtgctgattggtcaaaacccgtagacgaatacacattaggaacaggaatgcgtttctactttaattccaccggtgtttatctgggcggaggtctcgactggaaccgcttccgttggagcggaggacatcaccagactgactgggggctaggcatcgaagccggatacgcttacttcctttcccgcaccgtaaccatcgaacccgccgtatattacaaatggcgcttcaacgatagcgacatgtcacgtttcggcgttaaggtcggattcggattctacttttaacaatggataatggataattgaaaatggataatgagctgcgctgtttactgcatagccattatccattattcattaagcaagcttttctttcagaaactgccccgtatagcttgctccgcaagcggctacttcttccggggtacctaccgctacgatatttccgcctttgtctccgccttccggtccgaggtcgattacataatcggcacatttgataacgtccatattatgttcgatgatgacaatgctgtgtccccgtcggatgagtgcgtcgaaggcatccagcagcttgcggatgtcgtggaagtgcagtccggtggttggttcgtcaaagataaacagggtcgggtcggctttctcctgactcagatagaatgccagtttcacacgctggttttcaccaccggatagggtagaagaggactggcctaatttgatatatcccagtccgacatcctgtagcggaagcagtctttttacaatcttcttctgaccgtgttcggtgaagaattcgacggcttggtttactgtcatttccagtacatcatagatgttcttatcctggaatttcacctccagtgtatctgctttaaaacgtttaccgtgacaggattcgcattccagcaccaagtctgccataaactgcatttctacggtgatggttccttcgcctttacattcctcgcatcgtccgccttcgctgttgaaactgaaatgtccggctgtgtatcccatttgttttgccagaggctgttccgcccatagcttccggatttcgtcataagccttgatgtaagtcaccggattggaacgggacgatttgccaatcgggttttgatcgacaaattcgatattcctcaagtcacgcaggcttccactgatagaagagaactctcccgggcggtcgctgcattcatccagttcgcgttttagtgcccgatagaagatatcccgcactaacgtactcttaccggaaccggaaacacccgtgactactgtcatcacattgagagggaactttacattcactcctttcagattgttttcgcgggcacctgtcagttcgatataattgttccacggccgacgatgttcgggaacgggaatctcctcttctcccaacagataacgtaccgtatgactattgctgccttttttcaggtctttcatatcgccctgataaacgacttctcctcccaggcggccggcattcggaccgatatcgatgatgtaatcggcggcacggattatttcttcatcgtgctctaccactaccactgtgtttccgagttcctgcaattgacgcaatacgcggatcagacggtcggtgtcacggctgtgcaaaccaatactcggctcatccagaatatagagactgccgacgaggctgcttcctaatgacgttgccagattgatacgctggctttctccacccgacagtgagttgctgagccggtttaaagtcagatatcccaaccctacatctatcagaaagcggatgcggctgttgatttcaatcagaattctgcgggctacattgctgtcgtgttcgttgaggttcagatggtcgaagaactcttttagttcagtgatgggtaaatctaccagttcggaaatgctctttccgtctacccgcacatatcctgcctccggtttcaaacgtgtaccgtgacatttcggacagattgtttttccccggtagcgtgccagcattaccctgtactgtatcttatattgattctcttccagcatcttgaagaaatcgttgatgccatggaagtattggtttccttcccagagtgtgcgacgttgctcgtctgtcagctcatagtaaggagtgaaaatcgggaaatcgaacttatccgcattatgaatcagttcatctttccattctcccatcttctcgccacgccagcagacgatggccccttcatacacggatagcgagcggttgggcactaccagatgctcgtcaatgccgatcaccttgccgaagccctcgcatacggggcaggcaccgataggagagttgaacgagaacatctgatcgttcggctcctcaaaagtgatgccgtccgcttcgaatttcgtactgaaattatatagcctggtggtgccgtccggcagataaaaacgtagcatacacgtaccgtccccttcatacatggcagtttcggcagagtccgtcagtcggctgatggcatctttcgtgtttgccactgccatacggtctaccagcagataaacttcgtcgcctgccaccggcttgtattcatcgatacgtttcatttcaccgttcacttctacccggttgaagccttgtttcaggtctatctccagttgttgctgcagggtacggtcttcgcgcaggcggataggggtcaatacggtatatctggtcccctccggatgcgaaagcatacagttgacgatgtcctccgtcgaatgcttcttgacttcttctccgctgacggggctatatgtccgtcccacccgcgcataaagcaagcgcagatattcataaatctcggtggaagttcctacggtagatctcggattgcggctgttcactttctgttcgatggcgattgccggtgggattcctttaataaaatcacattcgggtttgctcattcgtcccagaaactggcgtgcgtagctgctaaggctctcgacataacgacgttgtccttctgcatagagagtatcaaaagcgagcgacgatttccccgaaccggatagtccggtgatcacgacaagtttgttgcgtggaatatctacatcgatgtttttcaggttgttaacccgcgctcctttgatcgaaatatgtttgttttctgacataaaatactccttttttatgatagtcggcaaagttagcgattttattgatagaagaaaggtttttggtcgggttaagatatgttataattggtaataaaaagaaattgcttcgggataattggcgtatcttggtccggaatttacaacaaacatttcaaaataataacaaattgacttgaatcgtgaaaaacatccggatggttattagcttattcattctgtgttttgcatctactttagcctttagtagcacaaacaaagaaaaacagttggaagccctttccgacagtgtctcaaataaaataggtcagaaagattttatacctttctatcaggaatatatgcgattggcaaggcagcagaatgatactgctaaaatcgacgatgcttattctcagattgcttcccattattaccggttgagaaatacggatagcctgaaagtggttgcatatgaatatatggactggtgcctgaagcgtggtaatatcaataatcgctatacgcagtggcgccagtatattcagttgcttaccgagaaaggtttgcaggatgaggccatgcgtgagactggacttcttcagaaggatgcggatgcggccaaaagtgctttcggaatggcttgcagcgagatgtgtatcggatataatcatcgggtgttcagcaacaacgtcaagctctgtcttgaatactattcttccgcactgaaaaaatttagtgatgcgggtttttatgaagatgcctatgtggtgtcactgaatatcatccagacttatctggctagaggggagtatgccaatgcgatggaatacttgaaccgtatgccgggactgattgagaaaatgaagcgtaaggatatccctgtccgaccggagcttaccatgcgttattatcagtttcaagtgattgctacgctggcattgaaagggaagaaggaggcgcaaccgtttattgcagaagcggataagttttatcacgaaaatatgaatgcttttccccgtgaaggatggttgggatataaaattctttgtgcgcggacgttgaatgacaatcagatggcactcaactatctggactcattgatggattatcatcattcggtggggagctgttatcctgccaatcacctgttgaaagcccagtttatggagcagatgggacgctttgaagatgcctgcgaggtttataaatcttatgcgcatattaatgattccattcgttcggcagagctggacgagcaattaagcaaatatactgtgcaattcgaagtggacaagctggagcacgataagctggaattgcgggcggaggtcaaccgcaatctctttataacttccgtgattgtcggatgcctggtgttgatattgttgattgttatcacgttctactatatgcgctccttgtcgttgaaccggaaactggatgcggcaaataaggccgttatcaaggccagccatatgaaaagctcttttatccagcatatcacacatgaaatccgtactccgctcaattcgattatcggtttttcatccttgatggctgccggtgggctgacacaggaagagatggaagaatatgcccgtcagatggagagcagcaacgcatatctgcttgatttggtaaataatgtgattgatatagccgacatggactctcagacggatgatataccgaagaagccagtgagtgtagatgcgtgttgtcaggaatgtttaggattgattcgtcagaatctgaaagaaggaatcaagttgcaatatatgccttcttccactccggtcgaagtgtgtacggttgaaatctggatgaagcgtgtgctactcggtttgctgaacaatgccaataaattcacggaaaccggatttatacgtctgagttatgaagaagacaaaccgaatcgtctggtacgtttcattatcgaagattccggtcccggaattgaagagcactttcgggatgcgattttcgaacgctttgcaaaggcggataccttcactcagggcaccgggctgggattgtctattatccgtcagatcatggaattagtggatggaaatgtctatctggacaccagctacgcgggtggtgcaagatttgttgtcgaatggcctcaataatagttggagatagtatctgcatctattatctttgcaccacattattttatgactcaagaacattatgaatctgaaaaactatcttttcttattagttctgcttctggcggcaggagtaagagcgcaggcgccatcgggcaatgcatatcctaaacgtgagtttcgtgctgcatggatacaggctgtcaacggacagttccgtggcataccgacagagaagctgaaacagacactggtcggtcagttgaactctcttcagggagcgggtattaatgcgatcatctttcaagtgcgtcccgaagcggatgcattgtatgcttcacaacacgaaccgtggagtcgtttcctgacaggaacacaagggcaaatgccttccccgatgtgggacccgatgcaattcatgatcgaagaatgccataaacggaatatggaattccatgcatggatcaatccctaccgtgtgaagacttcattgaagaatcaattggcaccgacacatatttatcatgaacatccggaatggtttgtcacttatggtgatcagatctattttgatccggcacttcccgaaagccgtgagcatatctgcaagattgtttccgatattgtatcccgttacgatgtagatgctattcacatggacgattatttctatccttatccgatcaagggagtcgatttcccggacaatgcgagctttgcccgttacggaggcggtttcagcaataaggcggactggcgtcgtggcaacgtaaatatcctgatcaagaaacttcatgaaacgatacggggcatcaaaccgtgggtgaagttcggtatcagcccgttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgggagataggacacaaggcagccgattacgaaacactggttgactggtgggcgaagcatacggaaaaccgtccgttgtttatcggtcaggcagtcatgaataccattcagcatgccgatccgaagaacccttctatcaaccagcttccacgaaagatggctttgcagcgttcttatcagactatcggcggaagttgccagtggtatgcggcagccgtagtcgagaacgctggaaaatatcgggatgccttggtacaggagtatcataaatatccggctttaattccggtattcgactttatggatgataaagctccgggcaaagtacgtaagatgaaaaaggtatggacagaagatggctatatacttttctggactgctccgaaagcggagactgaaatggacaaagctattcagtacgtagtataccgtttcggtcccaaagaaaaggtgaatcttgatgatccgtcacatatcgtagctatcacccgaaatcctttctacaaactgccgtatgaaacgggtaagaccaaataccgctatgtggtgacggctttagaccgtattcataatgagtcaaaatcggtaagtaagaaggtcaagctgtaaggactgcatgttcacctaccacctccccctgcgggtactcctccttctcgaaggaggagattttaagatactactgactttttagttagcctcttattactttattttaataaagcagtagtcctgcaatcccgcaggcgataatcattaatatcggatttgccttgtattttctggtgccgataaaggctatcaggaagataatgatgctgatgacaaatgtgtaggtgtcttctgtaggtgagccgaagttttccacattcatcaataccagtgcggcggaagctaataatccgacaactgccggacgcaatcctgcaaaaatagattccactaccggatgtttctgatatttcagaaagaatttgctgattgtcagcatcagtatgaaagaggggaaaacaacagcgaatgtggcaacaatcgatccccatacacttcctgtggacgtaaaaccgacataagtagccgcattgataccgataggccccggagtcatctgactgatggcaacaatgtctgtgaattcttgcgaagtcacccacccataacgggttactacttcaccttgtatcatcgaaagcatggcgtaacctccgccaaaaccgaaaagtccgattttaaagaacgtataaaataactgaagataaatcatctctttttaatttagaattatgaatcttgaatcatagccttgggtgttcactctccacttttttaaattttccccataggaaacctcctacaccggcagcaatgataatccatatcggggagaagcccaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgacggggatccataagttgtaccggttgattttggccgaccgtcccatggtgaaagtcggtgcggcgatcaatgccaccacggcgggtcgtattcctttaaatatgcgttccacaatcggattgtccttgaaagaatggaaaaagagcgcgatggccagaatgataataaatgaggggagtatagtccccagtgctgtgacaatacttccccgaatgccacgcagcttatatcctataaagatagagatattcactgccagaatacccggagcggactgagagatagccagcaggtcgataaagtcttcctgtgcgatccattttcgtttggttacgatttcattctcaataagtggaaccattgcatagcctccgccaatggtgaaagcgcctattttaaaaaagattccaaatgattcgaggtaaatgttcattcttctttttctcctccttccttatcggacttgttttcttttccagccttgccctccttgtggggcttgccttcttttccatattggctggggcttacgttgaagtgcttcttgaatacttcacggaagtacttcgcatcactaaatcctgtcatttctgctatttctgttatactgtgtgtaccttctttcagcaacttcaccgaacgtttcaggcggatcaggcggatgtaatcgcccggagcctgatcggtcaatgccctgagtttgttgtagaagctggtacggctcattcccatcagattgcaaagcacatctactgtaagagccggattgtctatattatcttctatattcttccgtacattggcgataaacttccagtcgatatcctgcgagcagttgatgcattcgtcttcatgatcatcctcatcgtccatatccagactcccgtatttgcttcgcaaaagggcgcggttgatcaacagattggagacggtagcttttaatattccaatattaaatggcttgacaatatactcgtcagcaccaatctgaaggccggacaatatgtctttttcattattaagagctgttagcaggataacaggaatatgcgacgtctcgatattatttttgatggcgtcacacaattcatcccctctcatttccggcatcataatgtccgagataaccagttccggtttgtattccggaatgatggtcagtgcttctttgccgttgcagcagttctgtaccgtatattcttctgccagtgtctgtgacagatagttgcgcagttcatcattatcttctacgattaggattcgctgatgattcggattctgttccttatgcacattctcatagatgctggcaggcacattggttgtacttgttatctcttgccggcgtttgcttggtgtggcaaggtgtgctttatggaagcgtttgctgtcttttgggaaagatatcttaatcaccgatccctgattctccacgctcgacaggttgattttgcccttgtgtaaccggacaagtttccataccagcatcaaaccgataccgcttcccgtcactttcgaattgatggcattgctgccgcggaaatgaagcttgaacagtttcttttgctcgctggctggaataccgattccggtatccttcacttccacgctccacgaatcattgttctctgatacgaaaatctgcacattaccattttccggcgtgtattttaatgcgttcgatattatattcttcagaatagattccatcttttccttgtcaaaccatacattcatataccggaaattgctttcgtacgtaaagttgatatgcttgatattggcataaggctgaaatgcattgaatatttctgtcatgaacgtgtttagctcatgctccgaaatgtataattccgaagaataaacatctgctctctcaaagttgataagattcgttgtcagacgcaacaaggcatttacattgcgtatggcagtgttcatgttggctatgccttccttgctcagagcttctttttcgcgcaaatcttccagaggagctttaatcaatgtcaacggggtgcgtatatcgtgtgccgtattgatgaagaagtgtattttttcatcggaaaccttccgctgttttttcagaataagaacccgcaggatgataacagcaatgagggaaatcaggattgcatacaatatcattgcccagggagtgagccagaaaggctgggcaatgataatatcaatgcttctttcttcaagcatcacccgttggtcttcgttggagatggcacgcacacgcaatacatattttcccggagcgaggttggtataacggattgtactttcattgccgggtttgctccactcttcgtaaaattcttccagcttccatgaataaagaacattggaaggataatcatagttgatggaagaaaccatcagtgaaaagatattctgattatattttagtcttaattctttggtttcgttgatatctttttccagtggtgaattcttgtctcccggatataccgtctgataaaacagcttgaaatcactgaagatcatcttggaagagtacgtcctggggagcttcatgtctttattgaactctatggcaccgtccgagctaccgaagataaaattgttatttctgcgcagggtaccggacaacgcattgaagtgcgtagtcatcagtcccatttcctttgtccagttgtagaaggttttttgtttgggatagaagctggtgagtccgttctccgtacttaatagaatttcattgtcttcatccgataatatcgtgtagatattgttggatatcatggcacagtttcctgtataataatgggtaaacaactttgtctggggatcataaatcagtactcccgatccgctggtacctatatacagtgagccttgtttggtctgatacagggagtagacataggtagattctaccggcagttggatgcgttcatatttcccggattctatatccagaagaaacaggcctgttgccgtacctatccacatacttttgtcatccttttcgatgatggcggtaacggaatgcagtccgtggtagagccgtatgtctttggtttgtacgttgattcgcttcaggttataatatcctccgctccatacataaccgcgtgagtctttgcgtatgtcacgtatgtatttatccggacgtatactttcatgagcatacgaagcgggtgtaaaataagttgttttcgacgtgcgtttatctatctgataaagtcccgagaaatatccgcctgcccaaataatgccgggagatacttcacataaggttgtaaatatatgatttttgctgttctgtacattctcaaaggtgctcagaaacgagcgccattttccggtttttgagtcttgcaggctaattccgttgttggtgccataccataagtctccctcgctgtcttctatgatagagttcacctggtcgttaatcagcgactgcttattaccgacagaatgtttgatccatttataactcggataacgattgttctgaatggtaattcctatcggatagtttgccatccatatccgttcttcgtcgtctatgtagatgtcgttaatgctgttgccgttcatgccattgtagctgttgtagtctgctacgataaaaggtacggtctggtacgtatcgacattcatcttatagatacctccgccatcggtagcaatcagcagttctttggcattcagtggtttgatgcgtgatatacttacgtctttcaggctgacttccggttgtgtgatggtttttgtgttcatgtcgtaaaccatgacgccccgttcgaaggcaccgatgaacagtttgcggattttggggtcgaagtgtaaatcgttaacttgaatattgacgttgtctagcttgtcgcaggggagaagttgcagtgtgttgtttttcagttgggcatgatgaatacccatctccgtcccgataaaatagtgggattcgtcgatttgttcgatgtcgtttatagcttcgctgaggcagtttttaacatgagtaacctcttccgtccgggtgttgtaaaggaagatcgtttcttcgttgcacagccagatatgattgttatgatcgatccagctgaaagtaatgggagccggtaaatccttaaagtcttctatcggcaacttgtagacgagttcgaaagtgtcatgaatacggtcataccggaaaatcttgcctttcttaccgatttcccatagcgttccttccggatcgatatataaccaattcagatttaacagcgagttgagttctttgtcgccgtccattaatttataccgtttaaactctttgccgttgtaccggtcgattccctcgtgcgtaaggaaccacatatatccaacattgtctttttgaatgtagtacactctccggttgcttaacccgtcttccactcctagatactgataggtctgggcgacacaggtcagaggaaacaataataataaaaaaagccattttttcatacaaataggacttttatgggttattgaatctttagtgagggggaaagtttgacaaaattaagaagatttttcgacactacaaaattttaggttaagataacggtgctctcaaagtgaagtatacaggagctttcgcagctatttgtatatcctgtttatttagggaaattaagttgtaatatgcagactttgggtatggaaaaggagttaaaacaagaggctgttactttataacaaataacagcctccgtttcaatgatagaaagatatcttatttagtcttctcttctacccatttgcgggcgttgacaaatgcttctatccatggagtaatctgatcgctgttcttacggtcagcaggatagcagccattctgccacgggaagatagcacgttcgaggtgaggcatcattgccagatggcggccgtcggcgctggcaagacctgcgatagaataatcggaaccgttcgggttgccggggtattcatcgtagctgtattttgccactacgttgtattggtcttcatcgtaaggcagagagaatttaccttctccgtgagccacccagatacccagtttgctgccgctcaatgagccgaacattacactgcggttggtcgggattgtcaagcctacataagtcgattcgaatttatgtgagtcgttgtgcagcatcttgcctttcttttcgtgttccggattgataagtcccagttccatcatcagctggcaaccgttgcagatacccagtgaaagcgtatcttcacgtgcgtagaacttgtcaagtgcctctttggctttagggttgaacaagaaacctcctgcccatcctttggccgaaccgagtacgtcggagttggagaatccaccgcagtaaacaatcatgtttacatcttccagtgtttcgcgtccgctgatcaggtcggtcatcgtcacgtctttcacgtcgaagccggcaagatagagtgagtaagccatttcgcgttcgccgttcgttcctttctcgcggatgatggcagcgcggacaccgctcggagtacgacggtccggagtgataccatactgagagagtttacctttgaatccgggcatgaaagcgaattcaaccggttgcatcttgtagttttcgaaacgtttctttgcgcagccgttcatagactgtttgcggtcgagcaggtaagaagaagaataccatacatcacgcatatagtcaacgccgaactgataagtagcgtcgcccttcgataccaggatatgacgttcgtcggtcggtttacccagtttcacgaatcctacgcctgcatcttccagaatctttttcacttcttctttatgcttgtcgctgatctggatcacgatacccggattttctgcaaacagaatcttgatgatatcttgttccttcatcttgtcgaggctgatttccataccgccttcaacgttggcgaagcacatttccagtaatgtagtgatcagaccacctgctgaaatatcgtgtcctgccaggatcagtcccttgttcaccagttcctgtacggcaaggaaagcatcgcggaagtattcggcatcctgtacgcagggtacgtcgtcgccaactttacccagagactgtgcaaaagcggaacctcctagcttcagttcgtcaaagctgaaatcgatatggtagagtgttgtcttttcgttgttcaccaataccggagatacgactttcttcacgtcggatacttcaccgccggcagaaacgatcactgttcccggagaaatcactttctcgccgttcggatatttctgtgtcatggacaaagagtcctttccggtaggaacattgatttgcagagcgcagcagaagtcgctcaatgctttcacggcagtgtaaagacgggcgtcttcaccttcctgtgagcggcacggccacatccagttggcagacagggaaatgctgtccatgccttctgccatcggagcccatacaaggtttgtcagtgcttcggataccgaaaggatagagccggcagccggatcagccagtgcggcttgcggagcgtgaccgatagaagtggcgatacctttttcaccacgatagtcgagtgctacgacaccacagtcgctcaacggcaattgaagttcgccctggcattgctggcgggctactttgcccgtaacggaacggtctaccttatttgtcagccagtccttacaagctacggcttcgagttgcagcacattggtcaggtattcatgtaatttcggcaattcgtattccggcatttcataatgacgttctacggtcttgtcgatcatataagtcttcggagatgaaccgaacatctgctcaacggccaggtcgaacggacgtacgccgtctgcctgctggaaagagaagcggtgatcgccggttgtttcacctactacgtacatcggagcgcgttcgcgttcggcgatcttacgtacatgttcgatggcttcttctttgatcagaagtcccatacgttcctgactttcgttggcgatgatttctttagcggacaatgtcttgtcgccgatcggaagtttgctcatgtcgatcagaccgccacattcttccaccaattccgacagacagtttacgtgacctgccgaaccgtggtcgtggatagaaactaccggattcacatcttcctcgcagagagcgcgtactacgttgttggcacgtttctgcatttcggcgttggcacgttgtacggcattcagttcgataccgctgctgtaacgaccggtatctacagaagatacggaaccgccacccagtccgatacgataattgtctccaccgatgacgactactttgtttcctgcttccggagtacctttgaggcagtcacgttgtgtgccgtagcctacaccgcccgcaagcatgattactttgtcgtagccataaacttcgttgttttccgtgtgttcgaaagtcaatactgagccgcagatcagcggttggccgaacttgttaccgaagtcggaagcaccgttggatgccttgatcagaatctgttccggagtctggtacagccatttgcgtaccggaagaatatcttcccattcgcggccttcgtccgtgcggggataagaagtcatgtagacagcagtacctgcgatcggccatgaacctttgccaccacccatacggtcgcggatttcaccgcctgtaccggtagatgcgccgttgaacggttctacagtcgtcgggaagttatgagtttctgctttcagtgagatgacgcttttgatgtctttcacctggaagaagtcaggttttgagtgatctgccggagcaaactgttcaactaccggaccttcggcgaaggctacgttgtctttataagcagagatgattttattcggattctcctgtgtggtctttttaatcatctggaacagagatgattcctgttctacaccgtcgatgatgaatgttccaccgaatattttgtggcgacagtgttcagagttgatctgtgcgaaaccgaaaacttcggagtcagtcaacttgcgtcccagatcgttttctacctttttcagatagtccatttcttctttcgagagtgcgaggccttctttttcgttgtaggcttcgaggtcttcgatggatacgataggttccggttggcggttggtggtgaatacgttttggtcgagtcctttgtacatgcgttgcagcatcgggtcgtagtcggcattttcatcttttaccggaaaatattcctcaatgcggagaatgtcttcaagtcccatgttttgggtgatttctactgcgtttgtactccaaggggtaatcatttcgcggcgtgggccgacgaaacagcctttcaggttttcttcactttccgtcacggcttctccaaaaagccagcagagtttattactttcgtccggggtgagctgatggttgctctctacggcaatcacgctcttggaaggggttctgaaaaaaagaatcatgtttattttttgattttacgatttttctgtggcgcaaagataagcaattttggtgtatatagtgactcttgtgtggaaaaaacgttaatatcctatcctcttctcataaaaaagtgcgatatttgcggcatgattcagattgaaacaatattcgatataatagtgaaaggctttattataggcgttgttgtgtccgcacctctcggaccggtgggggttctctgcattcagaggacgctgaataaagggcgctggtatggatttgtgacagggcttggagcctcattaagcgacatagcttatgctctgttgacaggttatggtatgagctttgtgttcgattatattaataagaatattttttatctgcagttgttgggcagcatcatgctgctacttttcggaatctatacctttcgcagcaatccggtacaatccatccgtccggcatcgtccaataaaggttcttactttcacaatttcattaccgcattctttgtcacgctctccaatcctctgattatattcctgtttatcggactatttgcccgttttgcctttgtgcagcccggtgtcgtggtgttcgaagaaattacggggtatcttgccattgcttcgggggcgctggtgtggtggctcggaatcacttattttgtgaataaagtgcgcactaagtttaacttacggggcatctggatactgaatcgtgtgattggcagcattgtgatgctggtgtcggtggcgggattaatctatacgttgctgggagagtcactttattaagaagaaaacttatgaatcagatagccagacagcttaaagagaaaaacattgccgagtaccttatatatatgtggcaagaagaagacctgatccgcgccaatcatggtgagctggaggagatcgaggcgaatgtgatcgcccgttatccggaagatcagcgtcctgccctgcgagagtggtacggcaacctgatcaccatgatgaatgaggaaggggtacgtgaaaaaggtcatttgcagattaacaagaacatcatcatcaatctgacagagcttcataatgcgttgacttcttctcccaaatttcctttctacagtgccgcttatttcaaagcattgccgtttattgtagaactgcggaataagaatggcaaaaaagaagagccggaactggagacttgcttcgaagcactctatggactacttttgcttcgtctgcagaaaaagcctgtcagcgaggggactatgaaggcggtagaagctatcagcagctttctttccatgttggcaaactattacgataaagacctgaaaggggaattaaaacttgatgaataaatgagaattttagtgacgggtgccaatggtcagcttggcaatgaaatgcaagttcttgcaaaagagaatccgcaacatacgtattatttcacagatgtgcaggagctggacatctgtaataaggacgctgtttgggcatatattgctgaaaagcggattgagcttattgttaattgtgcggcatatacagcagtagataaagcggaagatgattcggaactggcttacaagctgaacagtgaagctcctaaaacgctggcatgtgcagcgcagtttaatggtgcggcgatgattcaggtgtctaccgactatgtttttgacggcaccgctcatattccttatacagaagaatgcgatccatgtccgaattcggtatatggaacaacgaaacttgaaggagaatatgaggtactgaatcattgcgaaaagtcagtcgttatccgtaccgcatggctttattccacttttggcaacaacttcgtgaagacgatgatccgtctgggcaaagagcgtgatagtctgggagtcattttcgatcaggtaggaactcctacttacgccaatgacctggcacaggccatctttgctattattaataaaggcatcgttcgtggagtctatcatttcagcaacgaaggagtctgctcctggtatgactttacggtagctattcatcgtttggcaggaatcacttcatgcaaagtgaaaccgctgcatacggcggaatatcctacaagagcgaaccgccctgcatattccgtactcgataaaacaaaaataaaaacaacgttcggcatcgaaatacctcattgggaggaaagcctgaaaagatgcatcgatactttataataaatatggcagataatacagaaatacagagacggcgaacattcgccattattgcgcatccggatgccggtaagacatcattgacggagaagttattgcttttcggtggtcagattcaggtggcaggtgcggtcaagagcaataaaatcaagaaaacggctacttccgactggatggagattgagaaacagcgtggtatctcggtgacaacttccgtaatggaatttgactatcgggactacaagatcaatattcttgatactccgggtcaccaggactttgccgaagacacataccgtacgctgactgctgtagacagcgttatcattgtagtagacggagcgaaaggtgtggaaacacaaacccgtaaactgatggaagtgtgccgtatgagaaaaactccggtcatcattttcgttaataaaatggaccgtgaaggtaaggacccgtttgacttgctggacgagctggaagaagaactgatgattcaggtccgcccgctgtcatggcctatcgaacagggagcccgcttcaaaggagtatataatatttatgagaagaaactggacttgtaccaaccttccaaacaagtggtgacggagaaggtagaagtcgacatacatacggaagaactggataagcagatcggtaagccgctggcagacaaactgcgtggcgatctggaactgatcgaaggagtttatccggaactggatgtggaatcttatctggcaggagattgcgcgcctgtattctttggctctgccttgaataattttggtgtacaggaattgttgaactgctttgtggagattgctcccagtcctcgtcctgtacaggcagaagagcgtgaagtgaaaccggacgaaccgaaattcaccggattcatctttaagattaccgccaatatcgacccgaatcatcgttcgtgtgtagcattctgcaagatatgttcgggcaaatttgtacgtaatgcaccctatcagcacgtccgtcatggcaagaccatgcgtttctcatcgcccacccagtttatggcgcagcggaaaacgaccattgacgaagcctatgcaggagatatcatcggtttgccggacaacggaactttcaagatcggtgatacgctgacggaaggagaactgctccatttccgcggcttgcccagcttctcgccggagatgttcaagtatatcgaaaatgccgatccgatgaagcagaaacagctggcaaagggtatcgaccagttgatggacgaaggtgtggcacagttgtttgtcaatcagttcaacggccgtaagattatcggtacggtcggacagttgcagtttgaggttatccagtatcgtctgctgaacgagtacaatgcttcttgccgttgggaaccggtaagtttgtacaaggcttgttgggtagaaagcgatgatcctgctgagctggaagctttcaagaaacgtaaataccaatatatggcgaaggacagggaaggacgtgacgtattccttgccgattcaggctatgtgcttcagatggcacaaatggacttcaagcacattaaattccacttcacaagtgaattttagtctgcttggtggaatttaacaaaaataattggtaaaaggggaagaattatgttacctgtaaataagggaaggagaaatgaatacaacattttgggagaaaatccagcagggggatgaagaagcattccggcaactctacaatgaatattcggatttactttacggatatgggatgaagattgccggtgatgataatctggtaactgaatccattcagtcattgttcgtttatctgtatgagaagaggcagagttgttccgagcctcagtccatatccgcttacctgtgtgtggcgctgaaacgcatgctgctgaatgagttgaagaaaactgctaatggcgtattcacatcattggacgaagttaattcaagcgaatatagattcgatttggagatagacatagaaacagcgattgtccgttccgaacttgaaagagagcagttagaagttctgcagaaagaaataaatggcttgacaaagcagcagagagaggtattatacctgaagtattataaaaaactggattcggatgaaatagccgaagtgatggggctgacttcccgtactgtttataatactacccacatggcaatatccagactgagagagcgattgagcaaatcattcctgttgactgtagctgctaatttatggatttttaattgaggtgaggatatggagaataggaaagaacttctggaacaatatatggaagacggcaaacttcctctgaaaggtgagttgtttgcacggaagtctgtagttggtgggaagttagaagaatttcgtgaagaaaaacgtgcggatgcattaacaagcagaccgaacgctgcaggaagacagaaactgattgttcttaggagcagttgtatctactggagagtagcggccctgtttatcctgcttttcggaataggcggttattactatctgtcggaagagaagattacgtctgaagcagtagctgtcgattacaagctaccggatggcagttctgtgaagctgatgcaaaactcaactttgtcttataataaagtgagttggctttgggggcgtaaactgaatctgctcggatcggccttttttgacgtgactccgggtaaaacatttactgtacgaacggaagccggagatgttacggtgttaggtacaaaattcttggtcgagcaggaaggaaaaacgatcactgtcaattgtgaagagggaacagtgaaggtagagacaccaatcggcgaacagacattgaatgccggtgaaagtgtacgctgtgatgagaataagattggtcctgttcaggaaaaggaagaactgcccgaagtactcggttatgaagatgatccgctggtcaatgtagtagcagatattcagcatatctttgatgtggaagtggtagggtgtgaaaaatataatgaactgtactataacggaaccatcctgacgagagatctgcacgaaacattgaaaaaagtatttggttctttgggaatcaattatcagttgagcgggcagaaagtcatattagaatagacgggaacagaagtccacaccgtaaaaaagagaaattatccttgatataaagcaggaagtgaaatatttctgcaattaaaaaacgcctctcagagaaagccattttgcatttctcaattattctctcttataaacattcctcctaaatcaccttagaaggaatactttttattttaataaggacgaaattatcgaagtcagcgaaagttttatccaattcataactatcaaattcaaatatttgtttactttgtactcccatcaaagaattttcaaataaatcaattctatacattatggcgaaaaagaaagaaaagaaagagaaaaaggccggcaaaaggatgagtaagaaagagctggcagcgttattgatagactttttccatgccaaacccagcgaaacgcttagtatgaagtatattttctcggagttgcatctcactacccatccgcagaaaatgctatgcgctgacctgttacacgacctttcagatgacgattatatttccgaaattgaaaaaggaaagttccgcctcaacaatcacggaacggagatgatcggtaccttccaacgcaagagcaacggaaagaactcatttatccccgaaggtggaggcgatccgatctttgttgccgaacgcaattcggcacatgccatgaacaatgacaaagtaaagatcactttctacgccaagcggaagaataaagacgcggaaggagaagtcatcgagattctggaacgtgccaatgacacctttgtaggtacactggaagtagccaagtcgtatgccttcttagttacggaaaaccgtacgcttgccaacgacatcttcatcccgaaagagaagctgaaaggaggaaaaaccggtgacaaggcaatcgtgaaagtaaccgaatggcccgacaaagcaaagaatcctatcggacaagtgatcgacatcctcggggtagcaggagacaatacaacagaaatgcacgccatcctcgctgagttcggcctgccctacgtatatccgaaagcggtagaaacagcagctgataagatccccgcagaaattactccggaagagatagccagacgcgaagacttccgtaaggtaacgactttcaccatcgacccgaaagacgccaaggacttcgacgacgcactttcgatccgccccatcaaagacggattgtgggaagtaggcgtacatatcgccgatgtgactcactatgtaaaagaaggcggcatcatcgacaaagaagcagagaagcgggcgacttccgtttatctggtagaccgcaccattccgatgcttcccgaacgcctgtgcaacttcatctgctccctgcgtccgaatgaagagaaactcgcattctccgtcatctttgacattaccgaaaaaggagaagtaagagactcccgcatcgtacataccgtcatcaactccgaccgtcgcttcacatacgaagaggcgcaacagatcatcgaaacgaaaacaggcgattttaaagaagaagttctcatgctggataccatcgccaaagcacttcgcgagaaacgtttcgcagcaggagctatcaacttcgaccgctacgaggtgaagtttgaaatcgacgaaaagggcaaacctatcagcgtatacttcaaagaatccaaagatgccaacaagctggtagaagaattcatgctgctcgctaacaggacagttgcagagaaagtgggacgagtgcctaaaaacaagaaacctaaagtacttccttatcgtatccacgatctgcccgatccggaaaagttggaaaacctgtcacagttcatcgcccgcttcggctataaggtacgtacaagcggaacgaaaacagatatatcaaagtcgatcaaccatttgctggacgatattcatggcaagaaggaggaaaacctgattgaaaccgtatccatccgcgccatgcagaaagcgcgttattctacgcacaatattggtcactacggactggcattcgactattacacccacttcacttcacccatccgccgattcccggatatgatggtgcaccgcttggttacgaagtatatggatggcggtcgtagcgtatccgaaagcaagtacgaggacctctgcgaccatagttcgaacatggaacagattgcagccaatgccgaacgtgcttctatcaaatacaaacaggtagaattcatgagcgaacgtctcggacagatttatgacggtgtgatctccggtgtaacggaatgggggctttacgttgaactcaacgagaacaaatgcgaaggtatggttccgatccgtgacctggatgatgactattatgaattcgacgaaaagaattattgcctccggggacgccgtaagaacaagatatatagtctgggagatgccatcactatccgtgtggcacgtgccaatctggagaagaagcaattagactttgcgctgattgagaaatagaaacaagtactgtaaaaacgaattaatagtatactcttctgtgccaccctattggcacgcttgtgccaaaggctgggcatagtagtgccaatgcgatggcacaactgtgccagaggcttggcacaaacctgtaaaaactgacattagaatgaaaacaatcgttatcgaagacaagcaacgaatcgaatccattattcttcaagccgatgcctgctttgtaggcataacggacctggaaggcaatccatatgtagttcctatgaacttcggttatgaaaacgatactctttacctccattccggtcccgaagggggaaagatagaaatgctgcaacgtaataacaacgtgtgtatcacgtttagcctcggacacaaacttgtctatcagcacaagcaggtagcttgcagctacagtatgcgctcggagagtgccatgtgccgtgggaaagtagaattcatagaagatatggaggaaaaacgtcatgcactggacattatcatgcgccattacacaaaggatcagttcagctattccgatcctgccgtacggaatgtcaaagtatggaaagtacctgtagatcagatgacaggaaaagttttcggtctgcgggcagacgaaaagccatgagatgtacaaatctcatggaatcacctgcaaaatcatgtattttcatgatgttataagtcagtctatcaggcattaatactcaagttctcaggtgttaatacctgatacgacaagtattaacatctgagaagtcaagtgttaatgactgagaagtgaaatgctaatatatgaaactctatcagtattgatttacttcaccatctatatactctgccctatttttcaaccaattcttcagttctatcactttcgcatcaaaggaacgggtgttttcccataattcactatttctcgttacagatggtttaataagcttggcctgatcatctatatactgcaacaactcatttaatttatttgacttaaagtcttgccaaaagtttttatagagtttccttacccgactatcttgtaggaagcgttggaaaaaggcggttcccactccattcatatcatcagaaaagagcggagtttcataactcctgaaatgtgtctctttaccttcgtaatcatacgcccagtcaaagtcccaaatcggtcccataacatacttacccttcccctctttatgaataaagatacttttcggatggttaatctccatattgtgtaccaaattaaaggtaatcagatattttgcaactgattcaatatcaatcatatccacatacatatttccttctaacggctcctttgcaaactgcacggtaaatgcattaaaatctttcttccaatactcaaactgctctgtagtcaaatcagggtctttcaccatcaccggaagattgaatgcttcggacttgaatttcggatcttcatcaaaataggaatcaagctcccacatcacgctgttattctcatccaaatccacacgattttctttgatttctatctgttccgtcagtagataggaacctttgtatttgccattcagaaccacatccaccggaatggcatgattggtgaaaggaatattcagcaattgcccgactttgaaggcaactgagttaagcatcaaggtaggatcgatatgattagccagtaatacataattcttcgcttttcccaaaccacaaatctcagatttcttatcaagctttaaccggtaaggtttcttcggatatccccatgtggagtttccccttcctttcacctctgtcttgcctgtatagttctcataaatccccttgccatccacggtgagagtcgcattcaaataataatccttacttggtatttccgttatactagggtcttctgtcgtgatcgtaaactgaggaatcaggataaagtccagcgtcaggatgtatcggactacttctccattccgcatcacaaactgataagtgaccggagaggcgaaatcaatttccgtcacaccgctgacctgttctacatcatctaccattactttcacggcatcagtcataaagacaggaatcagtttcgattgtgggaatgtgtaggaagatacaatagtctcatcttcaatcgtacatgaaacatcagcagtcagcaaagcattatcttttctcaaaaagcgaaattcggataacacctgcgcatctttcaagacaacttcgactgtatattgttccctgctgccgtcttctgcttctacgagaatcatcagcggccgggaaaaatcattcgaagtgatgccggattcctgcccgactccattcacgcttacagacgttccttcatacttgaatgtagcaatcaatgacttcaggtcatcatattgatccattgacagcgttatcacattccctttaatggaacctctcacgtcattcttaattttaccttgattgtcactcttctgaatcgaatagctgattaattgcttcgttgaagagagaggagtttcttcatctttacaggcagaaaacagcaggagaataatcatcagaatccctaacgtcttgttttgcatagtattaaataaaaatggttacttggcaaatatacggttttgccaagtaaccacaggattattctctatatttctttcaaaaaaacgttcctttacaaaggatactcttcaaacgcgtacaggatagtagataaataacgctctcccgtatcgggcaataaggctacgatcatcttcccttcgttttcgggacgtttcgccagttcggtagccgcatagacggctgctcccgaagatatgccgaccaacagcccttcttcctccgccagcgcacgactggtacggatagcgtcgtcattctgcacctgaataatttcatctacgacagaagcattataagtcttcggtacgaaaccggcgccgattccctgaatcttgtgaggtccgggctttccgccggacagtaccggagagtcggcaggttctaccgccaccgccttcacactgggatcgcgcatcttcaatgcttctcctactccgctaattgtcccgccagtacctacaccggcaacgaagatatcgactttcccctcggtatctctccatatttccagtccggtagtgcgtagatgcatagcgggattagcaggattttcaaattgctgtaagataacgctgcccggagtggcagctttcaactcttccgctttggcaatcgcccctttcattccgtcggcaccgggagtgagcacaagttccgctcccagagctttcaaaaggttacgacgttcgacgctcatcgtatcgggcatcgtcaaaatcagtttgtaccccttggcggcagcaacgaatgccaatcctactcccgtatttccactggtaggctcgatgatcgttgcgccgggagtcaagacgcctttcatttcggcatcttcaatcattgccaatgccacgcggtcttttacactgcccgcgggattgaatgattcgattttcacgatcagacgagccttcaagccgttactcttattataattacttagttccaacaacggagtgttacctaccaaatccgtcaatttccttgcaatcttttccatatatctgtttttaatttcctttgtttttaagatattacaaagatagtgcagtttttgttgacaggaaataccatatatgtggtaaatttataccatcattatccggtaacctaccattcatcaggaactattccagaaaatcagcccgcatgggactgaatgtgtctatcaatactcccgcttccagacagacgcatccatgcggttcgtcgggtgctacatagtagccatcgccggtcgacagtatctctttccggtcgccgatggtcagttcaaactttccacttgccacgtaggtagcctgactgtggtaatgttcatgcaacgtaccgaccgctcctttctcaaattctaccttgaccatcatcaactgtccgtcgtatcccattatctgacgacggattcccggagcggggtgctcccatttcaactctttctcaaactgaaaaacttcactacgcgttttcatattctctttcctatttaaataactgaaaacaaagatagcttttgatttccgtctaccaaatggattctacggaaaagacttgcaggtctttcacttcgatacggtttccccagaagtggagtccttctctgttgttagtgtcagggcggcgttccatggaataagaatacagtccgccgtcgataaatacttcgatagaggtgcggtcaatgtaaatatcggcactcaactccatgctggtcgggtcttggggagagtagaaacggccgttcagggtattggagttcatgtcgtagccgatcatgcgctggccgaaaaggttgaatccggcatccgtggcatgagagagtttgatcgttgtcttaatgcggagacagtcggcatcataaaactctttcagatggcggttggcctcatccgaagaaagagatttccaggaacgaagaggcttacacaaggattcgacctcctttacgggaacgttgacaaggcggatgccgtctttggtggtacgcaaagtcagttcggtggggagcatcatcattccgttgaaaggcataccggggtgggagattcttccccagcctatctggatacgtctgccgtcacttgccggaatattggtaaaggtctgggctgcatagatacttccggtggtatagcagtattttccggcttcgggagtaaataccttgccgtcgaaagagcctagcatatacgtaccggtggcaccgtacatcacccacttcgtatggttcttgtcaccgtcaaccggcagttcaaacaattcgggacattcccaaaagcctgtaacatggctctcgtatttccagtctttgagattggaagaggtataaatggagtgtccgtcgcgctcgttcagtaccagtacccaatgtttggagggcgcataccagaacactttcgggtcgcgtgtgtcctgagagttccatttctccttggagttgatcaccggattcttgtcgtacttcgtgaaggtacgtcctttgtcaaggctataggctatcccctgcacttgtctgtcactgctggcggcagtgaaggcggcaaccatggctggagtcttgcctttattgaatccggcggtattatcatagtcgatgactgccgaaccggagaacatcgttcctaaatggtcgggatacagagcgtccggtaattctgtccagtgtatcaagtccttgctgaccgcatggccccagtgcatattctcccagtctctttcgaaaggattgtgctggtagaacaggtggtattcgccctcataatagattaatccgttagggtcattgatccagcctctccgggtagtgaagtggaattgcggacggttcttttccttatacagttcagcttgtccttcgatttcgtcggactggtatattttactcaatcccttctcattgccgtcgtaggttatcttgatcgtctttcctttgaaagccgacacatctttaaacacccagtattccgcttcatccggcgccagacggataacgacggataaatccggcttgccgtttacttcaaaagtcatccttcctctgttctctttatgggagatggggaagttcagatattgcttggttattttaaaagatacttctccggctatcgctgccaaacaggagaaggataaaacaaaaagagtaagtacagttctgcttaatgtcttcatagctattttatttattagtttgtaaaatcggagtaaatgtagccaatacgaccgatttctgatataataaatgattcacagactatgagaaacgttacatttcacagatattttccttaaatgacctgtatttttcatcacttggccatttctctctattctttatcccacgttattattcagcagctctttcgtcttatccgcaagaaataaaggaatattaatcagattgccgtcttgtttcaaattcagcatcgaatatcgaatccggcaagcaggttgataaagtttctcgtactgaatcagacttttacctgttatattctggtctgctttcacttctaccggataaatatgattaccatgctgaagtaaaaaatccacttctgctttattaccggaagtccagtaacggaacgaagcctgaagttgtgctgtaagactttgcaatacataattctctgccaatgcccctttatattccgtatatccgggagtggacaataacaaaacacttgcatccagttcggacaattgcctcaacaaccctatgtctaatgcatagagcttaaaagtgctcaaatcatcgtaggctttcagtggcagcctaggcgacttgctcaaaactactttgttgacaagaccagcttgttccaaccataaaatagcatcttcgtattcacgcgcacgtgctccgggacgaaccagttgataaacaaacttacgattttctttcgccaattgagagggcagagagttccatacataattgatacggggcgccaacgtaggtgtagtatgtttcacaaaatccagagcatagtcattcaatatatcccgaagcgatgaatccactttttgcatatcattaaagtcaaccatcaaagaagcaggttcgggcataccgccacaaatagaataggcaatgaaggcttcccgcagtttgtcgaagaagatttggggaagaggcgctatttctttgacagagcacatatattgatacatcgccggatctttcgtattcagaaactccgtaaaagtcagcggatacatagacagatgatttacttttccaaccggaaaggaattgcctatgtgattcaggtaaattccaagtaaagaaccagcgcaagccactgcatattcgggtgcttcttcgcagaaatatttcaaagagttcagcgcttcattgcactcctgaatctcatccaatatcagcaaagtagtctgaggattaatttttcgtccatgcaaaaaggacaattgctgtataatgcgttcggggtctttagtcgttttaaagatatcgcaaagtccgctttcatctttatccagactaaaataggcaacatcttcaaagtatttctgaccgaaatacttcaaagcccacgtcttacccacttgtctcgccccatgaataaccaaaggcttcctgtttacatccgttttccaagccgctaacagctgaataattcctctttcaaacataccgagtcacatttttgatatctgaaatgtgagaacttacacatttttgatatgagtttcgtgcaaatatacacattatccatatcaaatgaaaggatatcacaggtctattacttgaacctcttcacataattaacgatcagatagcaggcaggaccgagtacctgtccgtggtcaaatccttgcagttcatataaagagactttccgattgccgatattcttcaataccgatgccagcagtgcattctcttcgtaccggtcagccatttccagattcttatcccccgtaatcagcacaacaggggcggtatccttgcgggccttgtttaccggagcaaattcgtcaatgatggggattccgttgggcaggccacgttctttgcggatggtaaaatgagtgacagtctgtccgctgaccggaagataggcagctacactatccgcatcggctccatatgcagccatgtatttcttatccattgccagaatcaacgtaaggtaacctcctgccgaatgaccggaaacaaagatacgatccttgcgaccgccatacttttcgatattccggaatgtccatgccacggcttcggcggcatcttctatataagccggattctttgctttcggactcaaacgataattaaccgccactactgcaaagccttgatccgtcagttccctgggaacaaatttacttcctccttccataccaccgccatgaaaccatacaatggtggaaaaatcttttttattctcgggataataaacatccaatttacaacgttccagacgataagcatctgtttcggagccggaaatgtaaggtacatccttgtcggtacgatacgtatcctgtgcctgaacgaggcaggcacaaagcaaaaagagaaggagaaaacaattctttttcatggttttattctttttcattcttaaacaaggacaaatataaaaccttatttttagaatcacggtcaaaaaaagaagatattaatatctcccgtcacaaacattaatatatgtcgtgacaggtcactttatctgacttctcaggtattaatacttgataccgcatctgttttattcctatatttgcaatattcttttattgcattttagtggaaaatcgcatttcagaagtctattttaatataaccatgataaaataaactataatgagaaaactattactcaacctttttctatccacagtaggtctcctgtttgccgggcaagcatccgctcaagaagaaattgctccgggaatcatcaagctgcaagcgggagaaattgacacttttaccccttattccttattcggcgggaaacctgccgtagaagcaatgaaacaacttccggctgcaaagccgcccttcagccccgacgaagtgcaaataaagataaccgaccgtggctgtctgatcgaagtccctctggaggacaacgaacaaatatacggtttcggacttcaattcgaaactttcggtcagcgtggcctgcgcaagcgcccgatagtaaacgacaatccgctgaacggactcggatatacacatgctccgcagacattctacgtctctaccaaagggtacggtattctggtcaacacggcacggtataccactttcctatgcggctccaatcagaaaaccgagcatagtcgtcaactgcaagcggaagaaagaaaacacattgctaccaccacagaagacttgtataagaacagaagcaacggaaataaagtccatatcgacgtacccggcgccaaaggcattgaggtatttatcatcaccggaccggaagtgctggatgtagtcaagagatacaacctcctctccggcggcggatgtcttcctccgatgtggggactcggattcaaataccgtgtcaaaggagatgcgacgcaagactccgtcatgcgttttgccaactatttccgcgagaaacagattccgtgcgacgtactgggactcgaaccgggatggcagacggccacttactcctgttcttatcgctggagcgacgaccgtttcccaaggcacaaagaaatgctggaccagttgcagcagaaaggatacaaagtaaacctgtgggaacacgcgtatgttcatccttcttcccccatccggaaggcgctggagccctactcaggcgatttccttgtatggaacggactggtaccggacttcatccagccggaagcacacaaaatatttaccgattaccaccgcacactgatagaagaaggcatctccggcttcaaactggacgaatgtgacaactcgaacatatcttttgcttccgccacatggtgcttcccggatatggcacagttcccttcgggcatcgacggagaaaagatgcaccaggtattcggttccctctatgtgaatgcgatggacagtatctatcgtgaaaagaatacccgcacctatcaggattaccggtcgtccggtatgttcatgtcttcacgcaacgccgtactttatagtgatacatacgatcccaaagagtacattcaggcactttgcaactcggcattcggaggactgttgtggtgtcccgaagtgcgtgaggcacattctgccgaagatttcttccatcgtctgcaaacggtgattctttctccgcaggctatggtcaatgcatggtatctgcaatacgctccgtggctgcaattcgaccgtggaaagaacgaacgtggcgagttcctgccggaagcaaagaggtatgaagaatatgcccgtacactgattaatctgcgtatgcagctgattccttatctgtacagtgctttttatacatattataaagaaggtgtacctcctttccgtccgttattgatggattatcccaaagatgaacgtttgcgcactatcagtgaccagtatatgatgggagacggattgatggctgcccctttataccagaacaagaaaacgagaacggtctacttccccgaaggaacatggtacaacttcaataccaatgagaaatatgaaggcaaccgtgaatatgagattacgacggaattagatcagttgccactctacgtccgccagggaacgttattgccattggccgcacctgtcccctatgtagatgctcaaaccgtattcgatctgcattgcaaagtatacggcgctccttcggcaacgttcctccttctcgaagatgacggtataagttacgatttccaaaaaggacaattcaacgaagtaacgctggaagctgcaaaaggaaaggtaaaacttaaaagaacaaaagaatacaagcagaaaagatatcaactgacagattacgagttcatcaattgatttcttaattagtttcactgcttgaaactagagtttcatcagtgagaaactgtagttccaaaggcttgaaaccaaaagttccaagcgtatgaaactatagtttcaagtaatgggaaccaaagtttcaagcaatgggaactgtagtttcataccttaaaacaaactcggcttattaatagctgaaatgaatgacagcgtgacggcaaatctttccgtcacgctgctgtcacaggttgctgtcacggtcttatgatttaattatcagactattgtcacaggtttagtgacagatgacagcaattcttcaaatttatatctttatgtaggcgttgagttcaagtcataaacgcagggaaatccgactttcttcccctcggtccggcatacgaaggctgcaaataccggtcgccttatcccaactccacaccatactttcagtgtcatcgtccggattctcttccagacgttccggcttcaccttctttactttcttgccttgcacggtaactcctttgggagccgtcttcagatacatacggaaaataaagtttcggggagcgggcactgcatacccttttccttcacgggcaccaaccgaaagaagataaccaccctcctccgtccggaagcgaacgggagttttggcaaactcatcccgttgatagccgaggtcttctccctcatcttcgtacaaagtgaacgaggcctcctctccttttggtgccggaaatacttcaaagatcagcggatagaccggtttctcatgcgtgtagttcatcaccggcatggtggggatgatggaaccctgctttacaaacatcgggatgcacgacaagggagcttccacggtagtccactgttctccggtatagactgtttgtttattgttgtagtcaatccaagtgccttcgggcagatagacattcttcgtacgtgcccccttcttcaccaccggagctaccagcagctcttgtccgaacaagaactgcccatcggtagagaacgtttccatatccgccggatattccaaaaagagaggacgcatgatgggcaatcccgtatcatgagcttcgcgggcatacgtatagatataaggcaataaacgatatttcagttcgatggcctccttcgcgttcttttccgcttccggaccgaagagccacggttctaccggattatccccctcatgatgaatacggctcaaaggattgaatgcaccgaactgtatccatcgggtataaagttccgccatggatggatagtcttcgatgtctccgcaataccccgtaatgtcacaggtagtaaacggaatcactcccagccctgcggaaagaatcaccggaatctgattagccagttgcccccagccctgcaatacatcgtctccatttccgcaatctcccgtccaaccgaacgtataacgctgcaatcccgcataagcggcacgggtcatctgaaagacgcgacggttcggattccgtttctcgaactgctctttgaccactttatcccaagtcagtccgtagacattatggatttcgtcgtgcatacccaggtgatgtttcatcacaaggcgttcggtctgctcttcgttgctccatgcgggttctcccatatccgtccagaagccggagatgccatcgtcaatgggtttctgctgataggttccccaccagtcggctacggcaggtaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaccgggtcttgcgatacgactaccttgaatcccatttctttcagatcggcaagcatctttttcggatgcccgtagttgcccttccgccattcgaagtcctgtagatgttccgtccagccgatgtcctgatagataatatcacaggggatgccgcgtgtccggtagccttcggctatttcgcggctcagtttctcgcttgtcagcaggccacggcattgcgcaaagcccaatgcccatttcggaggcatgataggtttgcccgtcagtcctacatactgactcaggatttccttatagtccttgccgaagatgaagtagtaaatcatctccccgtccggcgcctcgaagctgtaataatcacggctttccgttccgaacttaaattctgtcttatacgtattatcaaggaaaataccataccggtaactgctcataaagaaagggatgctcttgtaaagagggtcttccaccacactgtaacaaggtttatcgctgttccacatcttgtaagattctcctctgcggtccatcttgccggtcttctccccaagcccgaagaaatgctcgtcacggcgaagcgttttatattccaccttcttcgtaccttcgcttacgtgtcctttatcggcatagtcactgaagaggagtttctgatatttgtcgaatatctggatgctcatcggcgacttgttcacccgtatgcgcagcttcgaggtaaatatctcatagcaggcggcctgttcgtccacatgaaccgttcccacatcttccagttcttcattgatcacggcaaaggaagcgtttctccgttgcagcttcccgtccggcgagaaccagattcttaccacggaagggctgcaaagttgcagttgcagcgcggcactgtccgccaggtgaaaaatcacctgacgtccctgctgcgtaaaagaggtacatatactttttgcgttttctgcccagaccaacgccggaaacatcagacacaacatccacaccccaaacttatatctaatcttcatacctatcgtttttagttattccgttgcaactgccttattcagctacaatcattgtccagtatttcaaggcaggcagtgtgaaggagactaccccgttctcctgcgtaaatgccagttcctgcaaggctcctccgtgtacatccggtgatgccacccacaatttattcactttggcgggcaggttcatctgcaaggtcgctttcgtgatcagggcaggttcgggcatggtgccgtccacgtcccgccagctaaggctgttcgcctgcgagaagttaagcagatgcactacttgcttgccgtctacctgcttggcgtaagtagtgaccgaccccaactttggaggccatacgttgagtttcatttctccgttggtacagttcatagcgatgctgttctccgttccgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgagatgcgagccacccaaagcgaacatcaccgcatccgtcagcaggatgcccgctgtattgaactctccccgatgatccgccttattatagttcatataggcagcgaaaaccgtattcagctgattattgccatacactccgttttcatacaggacggctttcagatgggtaaagtccgcctcatccgcccacatctcattatagaagaaatctactttaccggtttctccgatctgacgggcaccgtagcggcttacggcattcatcaccagactcttgtcgggatgcgcctgcttcatggcttcgataaaagaagcatatccttcgcggaggttgaccggtgtaccgttgtagttgtaaagcgttccccgcttgcccaactggtcgatctgatagccgtcgaaggcgaagttcgcatacacgtcgtcattccgttccgccatatattgctgccattccttgtcggaaggatctaccagatagatattgctcttccatccgcttggcaggtcgtgactgtctttcgtggtatgcgaagcgtccttaaacagataccattcttctttcaccccgtcggaagccgcatccttcaatgccccgaaacaaagattatagaacatggacttcattccaaaatgttgttgtgccttgatataattcttcacagagcttgtatggacagggcggttcgcaatgtcgagatattcctcgtccaactgcgtgcgtgtgccgcccagcggccaatgatgtttattgtgccagtcctgaaactgtacccagttgatgtgatggcggttcagataggccatctcttccagtgttttctcttctgtcttgactccgtcgaaatctgccacgaagccatatcgggggaaacgtgccggatggctggatacatctaccgcaatcgtaccgacgatgacatccgtaccgttttcctgccggtaaagttctgccatgtatcctttgaaatcggtggaaggagccttccatgtccagttcgtaccgctgaccggttcttctccgactatttctcccaaaaggcgatagcgtacctttgttccggcaggcaaggcatcggcggcagtgaaagtcactgtctcgttcggtttataaaaagccttgtcagttgtcagttccacgcataagtccgatgtcaccggagttacttcggtcacactgcccgacgctcctccgttctgtgggttcgattcatgatcgtcgctgcaagacagacacaggaaggcagccaccaaatatattatcttcttcatcttgaatacttgtttattgttttacaattgaaatcgtttctttcaactggtcaatcgtaatccgatacgagccagcttcctgaatattccatttattgtccagactgccgaggtctgtatccggatacatattcttcagttccgcatccgttttactggtaaataaggctgtctccacttcaccggtcggtgcctttccgctcttgtccgccatcagccagtctccgttccagtcggactgcttgtcgcaggagatcttcatctcccctgtattcagtgtaccgctccaggtaaagatgtaagggctgtcggcacttttagccatcggggtggcgttgtcgatgctccatccgttcggagtggcatcgcctaccagatacagtccttcgtagggggtaaacggacgcatcagcatcttttcctttcccttggctgtgaggaacagcactttataggccttgccgcattcgctttccttcatttgccatttattgtcttcacctcccagtacaactgaagtggaagtatacggagcgttcccttcggtgggatggaagaaagcatccgactgaccgaagtccgtcacggaagtaaacttaaaatcaccgtccgccttccacggaatcacggcaccataatggaacagattcatctgaacggcatctttagacagtgcctcgaatccccagccattatcgccggtaaaggagccgacaatatagaattcttcaaagcgccatccgatgttttccgtttcggtcatggtcattgtcaggtcgagcaggtctaccttgactatataggtcgcttccttgctgactgtaaacggttcgtccggttcgtcgcccgatgtgcggtagataagccgtagttcttctccggcagcggcatcccggttgtaggatggaagaaattctcccaatgtcgttataaacttgaatacaccggtattcagctttcctgtccacgtaaactgtccgttgtccgtgcgctccataggcgtcgcttgatcggcgctccatccgttaggggcagcttctccgatgaggtaaagcgtcggagtaaccggttgataagtagtcacatccagcgcaactgtggcacgctgctccttttcttccattccggcaacagtagcggtaatgcgtgcttccagcgatactttttcggcatagccgacgcctagctgcgtgttcagaaactgattgagttcttccgttttcttcgtccactgataagttcccgttcctaaatctacggaataggcacgggcgaagtctgttcccgccttggctatttccagtgtataagagatgcggttcccgcttccgtagtttgttcccgtagtccatgaaagcgttaacgcttcctgagtgtgattcttttcgttcagtacgatctcctgctgattcaccgtaagagtcagcgtatcatgtcccttgtccgtctccatatagtcctcggcgcaggaaaccatcgctccaccgatgaaaagagaacacagtatctgatatatatatttcttcatcatatgatctgtctaaatgaatgattgtaaaagcaattaataaccgggattctgagtcatcagattgttagagtccatctctgtctgcgggatgggcagcagcaggcgttccttcgtcacctgattcttgccgatagatttcaggaactcaatcgcatagttaccattattgatgcgaatcatgtcaaaccagcgatgtccctcaaaagcaagttccatccggcgttcgtgaataatcttttcccgcattgtttcctgattcaaggtagtcggtacatccgccagtccggcacgctgacggacgatattcagaggtgcggcagcctgatcgggatgtcccagttcgttcagcgcttccgccttcttcaacaggacatccgcataacggtataccacgaagttattcgggttggtattatattccggcgaaacggtcttcgacacaaggaacttccggacgttgtaacctgtattcgaccacgaacgtctgtactccatgccgtcgaaagcaggacagccttgatataacacggtcacatctttgcgcaaatcgcccgcttcgtactctttgataaattcttccgtaggcagattccatccgtaagcgcctgccaccatgccggagttacggggtcccatgaaggtcgacagccaggaagactggttatcccctccccagaaatcgtattccgtactgccggagtattgtacttcgaaaagggattccgcaccgttattgatcgtagcgtcgaaattatcggcatacttgcactgagacaaatcatatcccatcgcagtaatctggtcgcacaacgtaacaacttcattgtaataatcccgatgattgggcgccagcgtcaggtaaatatctgccagcatagccatcgccgcctctttgcaggcacgtcccttgtcattttctccgtaactgctctttgggggaagcatatccaccgcattcttacagtccgaaagaatctgcgcatatacctcatctaccgtattgcgggcaatatccgtcgactgtcccggctcaaagggctgtagccgcaaaggtacgccaccataaagacggacgaggatatagtagtaatgagcacgcaggaaatatgcctcacccatgcaacggtcttttatctcatcggagatggcagccgaaggcagattggaaagcacgatattacaacgtccgatgcctacccacggagaacgccatacgtacagggcaaaaccgttgtcgctctgcgctataaagttagccgcctgaacagtttccagtccgtcggttcctcccccggcgcctacctcgctgttgccggcaaggatgtcgaggctccacaggcgctgattatacatattggacgactgcaacgtcttatagcaggcagtagtcagtgctacggcaatctcattggtcacttccgattcggggtccacaccgtatttggggtacttatccagaaaatcactgcacgatgtcaaggcaagtacggcaagtatcattataaaagtcagtttctttttcattttcttcctcctgatttaaaagttaaagttcaagcccatactgaatgtacgcgagatagggtaacggctgctgtctataccgttgacatccacctcggggtcgaagcccgaatatctggtgatagtcgccacattctcgcaagagaaggagatacgggcgttttccagttgaatcttttgcaaccactttttaggcagtgtatacgaaagggtgatatttttcagacggagatacgagccgttttccacaaatcggtcggatacgcggcagttctggttcgggtcgccccagatggcacgcggcatggagtagcttgtgccttctcctgtccagcggttcagtacggctgtggtctggttgtaggcggcagccattccttcgttgtccacattgttggcattataaatcttgttgcctgccactccttgcaggaaaacggagagttcccatcctttgtaagataggttgttggagagtgagaagaaccagttcggattcggattgccaagaatcgtacggtcttcgtcgttaatcactccgtcgttgttcaagtctctgaagcggatgtcccccggagctgcgcccggctgggtggcgtggcggttgacttctccccagttctggaaaagcccgtcggtaacgtatccatagaaaacgttgatcgggtaaccggctttcagcatggtcacgtatgaattgcctatctggttgataaacatcggagtttcgctgttcagatccagaatctcattcttattataggtagccgttaaagcggattcccaggagaagatgcctttcaggttgatggtacgcaatgtcatttccactcctttgttgcgcatcttgccggcattggtgaaagtctcggtagtatcttcaaagcccgaagtgatggggatggaagccttcaccagcatatcgttcgtattcttgatataagcatccagtgagaggctgacacgcgaatcgaacaggctcatgtccacaccgaagttggcctggcgcacttcttcccaatggatgttcggattggagagagtggtagataccaaagcagtggagttattgtttccgaaaggatagacacccgtgttgtaggatgcgacaaatccatagttaccgatttcctgattaccggtcacaccgtatccgacacgcagtttgagatcgttcatcaggaagttatctttcgggaaccagtcttcctgagaaacacgccaagccagagatacggaagggaatgttccccatcggttgttcttaccaaagcgggaagagccgtcacgacgtacggtagccgtcaggaggtatttgtcttcgtatgagtagttgagacgtgccatcagtgagagcagtgcccagtcgctctggctgccgccaaggctgtacatcttttctccgttgtccatctcatggatattgtcgaacatgaagatgtttttctgtgcgttcagataatcgtagttattccactgtgcggaagaacctgccatcacacctacacggtgtttctttgcaaaagtatgatcgaatacgaagtagttgtcccacaggtaggtgaatgatttgttgtcgcttttgtagcgggaagattcttctaccggattcggtttccagtcgtatgccggcgtgaagttgtcggcaaaccagaacttggcgtcatagccgaaggtacttttcagtttcagccatttagtgaaggtgatctctccggtgatgttcgcgagaaagttatatcctttcgtctcgttagtcatcatgtgaagcgtaccgatcggattgcggatacttccgtaccattgcgcctcctgtccgggaccgctccaactgccgtcgtcattcttcaccggttgggtgggaagggctttcatcgcatcaccgatactatatgttcctccttcttttacgtctgtgctgaatgtcaggttggtggtgaatttcagccatttgttgacttgggcgtcactgttcgcctgaaaattgaaacggcgataattgacactcttcacaataccggactgatcgagaaaaccgccggatacataataatgcgccttttccgtgccgccggaatagctgaccgaataactctgcttcactcccgtgcgcagcatctcgtcgagccagttggttccttttcccaatgaagaagggtctgcccagtaagggttggtgttatcgtcattgtttgagagcatatcattgctcaatgctgcatattgggcggcattcagcatatcaggcactttggttgcattctgtatcgcccagttcgcattgaccgttacctttccggcgccttcggcaccgcgtttgctggtaatcatcactacaccgttggcaccgcgcgaaccgtagatggcagttgccgaagcatctttcagcacgtctacccgttccacatcggccatattcagagaagacagacctaagtcggtagggattccgtcgatcaccaccagcgggttgctgttgttgatcgtgcccagaccacggattttaatggttacattgtcccccggtttgccggcatcgataatttgcacgccggatacttttccctgcattgcctgaccgatattggctaccggagagtctttgatatctttgactcctacggaagatacggcgccggtcaggtcgctctttttcatcgttccgtaacctactacaacgacttcgtccaatacttcggtatcttcctgcaaggttactttcagtgcggtttttccgttcaccgaaacagtctgcgtcttatagccgacaaaagaaatggtcaatgcgctgttagcagaaacatttaatgagaagttaccgtcgatatcggtaatcgtgccgttcgtggacttgccttctatcacactggctccgatcaccggttcgcccgtggcgtccactacatgtccttttactgtaatctgctgtgcgaatgcactaagagatagtaacaagccccacattattaataggaggcgatgttcaaagcctttcgactttatactctgttccatgtacatcaatttaaagttaatattaggattactttttgttttcactgaaacaaaagtatccacaattaaatgcgcttcttttgccagatagcaaaaatatagtggtttatacagtacaaaacagcataaaacactaataataagaatattatagaatagcgaccgtgctaaaaaagtagtggatttcttactcttccaccttccctattttcattactttagcctcaaactcatcccgttcgccgagtgccttgttgcggacacgtgtccggtaattataaatagtggtcacagagtagcggaggaactgggcgatcttggtactatccgtaatccccagacgaatcagggcaaagatacgaagttcggtattcagcagttcgccctgcttgggctgcatcggttcgacaagtaacgcattaaactcttccacaaagttagggaagagttgcaggaaggtcatatcaaagtttgcgtagaagtctttcagctcttcttcgaggaattgggaggatttaatagctttatacaactcttctaccctgccggcagccgcaatcttattcagagaacgacggtataagtccatcttatccagataggtggaacactggtccatgtagcggccgatgtattcctctttaatatagttagcttccgaaagggtatggttcatctctttcagttgcgaattggagtcatgaagttcaccattcagctcttgcagaagcgtattcgtgtcaatcacttcccgacgggcggcagccactttcttcatctgcttgtaaacgaagaatatagccaccagcaaaaagacggaaagcagactgatacaaatcagagatatcttcatttcctgttgctgccgcttggttttcagctggtaagcctgatcgatgatggggaagacttgcgagatttccagtgtacgaaggcgggcgttgcagagcgtagcatcttcgagcgagcatttcagatagttgtatgcacggtcaatgtctccgtcttcatatacaagagaggcgagtttccgcagggagacgtattccttgactgccgattttaaatcggcgatggccgagagagccagaaagtgtttctgccctttcttgtctcctttgaggcgataggcttctgacaaggtataagtaatcatcgccttggaatgatcgtccagagagggtttccggtagaagtcggtcagcatggttattgcctgatcatattgggcgtgtacggtgcatttgtcggccatcaccagcacatgacccaatgagtcggaggcattagtctgtaaaagggaatcccgatacaggtccgtcatccggtaatactctttcttctctttctcagtaacggcataatctcccatcaacccgtaaatagtacgatacaagtggtaataatagggatagagataatcagacagggttttcttgtctatctgtcccaactgctccaaagcttccttgtacattccggtggttcccatcacctctgccatattcatggcggcatcatccagataatcctgtttgttcaaatgagaagccagttcctgcttccgctgtgcatatacatacgaagagtccagattataagcccgatattcgtcgaaaagcctgccgcaaaatccataacgctgctcatcggaggtagcctcggacagcaacttcttcaaatcggagatacgtgcttctttttctgcaccgtaagtctgacggttcctgataattccgtcaatctcacgaagcagcatatctgtactcttatcatcatttcttgcgcaaagcaaacagggaagaacaattgtcacgaaaatcaaaataatctttctcatagcgccatatgtattatatctgcaaagataaaagtctttcagaaaccgacagccttctttgagaaattattgcaagtcttgggaataaaaacgtgtccgatcagtaagccctcaaaccgaaatcaaagctcatctttttagtttcccgtacttcgattttcaactcattctttccttttcgcaaatatcggcaataattactgatattgtactgattatattgcctggtttgtttcacctcctgcgaaaagacctccactccattcaaccataccttcacatctccggtagcacgcacccacaaagacaaatggctgaattcatcattgacatcaaatgaagtttccgacacaatttccgaacggggagggcaatcgaaaggcaaagaggtcattttcgactcctgcccgttaaggctgactgcacggctgaccgcactcccattctgagcgtcgggcaccaaagtaatgactttcgccggattgacatgatataaacgatcgtgcatgatatgcaacaagccttccggaattttaataactttccggtcataagtaatcagaccatttacttcaccttcgacatcagtggtttgtgtataaatcgccgcactcagcccctgtgctatcaatgtctccaaatcatagaccagacgaccatagttatccatcagcgccattgctccatcaatatttttatatccccagttccgcataccgggattccacagatgttctttgatggcccatccataccctccgaattctcctaagacagaaatccgattgccattacaagcgggcaaaatcatggaagcagacggataattgtgtacatcatacatatggcctactcctctgtctgtccagccggttactccgtcaatgatacggcttttatcgtattccattaccttttccactatttctaccgtattatgctgtccccatccttcattgaagattacccacgttgtgatacaggaataaaaacgcagacggtcaatcatctcgaacatctcctgttgccattggttagtatgtgatgcgggtgcattccagtccgtttgcgcattgggcttaatatgttcttcgtcttttctttcggtagagaagccggataccatatcctgccacatcatcaaacccaacgaatcggcataataataatattgctccggttctactttaatgtgtttgcgtatggtattaaatcccatatttttgagctgaaccatatcccaaagcattgcttcttcggaaggaggtgtcagcaaaccatccggccaccagccttgatccagtgttccatactggaatattggatcaccattcagacaaatacgctggtaaccacattcatctttgcggatactgacctcacgcatcgcaaaatagctttttacctgatctattacttgtccttgacttaacaactcaatattcagatggtaaagtttcggagaagacggactccaaagaacagcctccggaacttccatttctatctttgaggctaatttttgctctgtcgtacccactaccttaccttcgtccagtaattccacttttactttttctcctcctttggctttagctacactgatgtccagactaaccgtctttttatgaatatcagctgtaggaagaacctgaagaatatgggttgaatttacagcctccaaccacacagtctgccaaataccggataccggagaataccagatacctttcggctccaactgttgcttgccacgggaaattgactccgtatccgtagggtcgataacagcaacctcaacaagttgcgaaccaccttttctcagcaatttggttacatcgaaagagaaaggattattcccccctttatgaatgcccgccaatttgttgtttacccatacctgacattcataatctacagctccgaaatgcaaaatcactgtttttcctttccatgcgtcatcaagggtaaagttacgctgataccacaatttctcggtaggcagaaaagaacgctgcacccccgaaagggaagattcgatagcaaacggaacgagaatctgtccctcgaacttcacttcttttttaggtgtatcctgagtagtaaccgcatactgccataacccgttcagattcatccattgcgaacgttgtaactgaggacgcggataactctgccatacattttccgacgtaactttatcagcccaaactgttttcattctattttctttcgggcttgctgcgcaagcgaacgtatgtgccatagcacttacaaatactgcaattagtagtttcttgttcataagttcctatcttttctttcctactgtgttttcctacttatctctatattctttaaagtccttccggcgtcctttattataagtattccaaaccttcgggaaataaagcacatcactatggtctgcccactcaaaataagcgtcttccagttcctttgccatttcagggtattcctttatcagattatgttgttctgtgcggtcttctttgatattatagagttcccattcatcacctctaaaattcgcagagaccagtttccagtcacctttgcgtaccatacgattaccttcatgttccgcatagatataacggtccggcatttcttcaccgcgtacaataggaaggattgacttgcccggtgtaggtacaatctttcttccttcgtattcttcgggatatttagtccctgccagttcgatgcaagttgccatgatatccgagaattgtgccggttgatggtcaatactgcctttgtgcttaatctgtttaccccactggataatgcaaggagtggatattccaccttcatgcgcataatgtttataaagtgtaaatggggtacaacaaacgtttgcccagccggttccgtaatgatgataagttcccggtagtcccatctggtctaattcagcaccaacatgagtatgatattctgttccagtttgcttgtcgaaaccaaattcatgccattcggcacaagctccgttgtccgacatgaacatgataaatgtattatccagttcaccgttcttctgtaaagtatccaatacccgaccaatattggtatccataatatctatcatggcagcataaatagccatacggcgagccaggtcagtctgctgttcctttgttaaagaatcccaggcaggcagcggatgtgtctcatcctcaaacaaactttcgggaacaacaccacgcgggcttaatgctggttttccttgcaaaagccccatctttactattcgtttccaacgttgatctcgaatcttatcccaaccctgcaggtaaatcttcatatatttatccgttacttctttcggagcgtgcaacggaaaatgagcagcattgtatgccaaatacagaaacaaaggtttttcttcctgatgtgcctgattaataaagtctatggcataatcggttattacgttagtagcataaaattctccctctttatattgacgtgggttacgatccttaggcaatcgggtatatacgtccggattccaaaaagaattgaatccacctaacaaaccataatattccaggaaacctcggtttatcggattggcggttttgcccagatgccatttaccggacatggctgtgaaatatccggcatcttttaatacttcggcaatggtaacgttgtcagaattggaacgaaagccggcatatcctttcggccatgccggacgggttgcatccatgtgtcctaaccctgtctgatgcggataaagtccggttaataaattggcacgtgacggacaactccgcgcactgttatacatttgtgtcatacggacaccctgtttggccatcttatccaataccggtgtctgtacttctcctccgtagcaacctaaatcggagaaacccagatcgtccgccaatataacaatgatattaggcttttcttgtgcaaaagtcattgctccgaaagccaatcccccggttatcaatagtgatgttttcattttgcctgataattgtgattaggtttaaattttccgttttcataaagcatcggaatcaatcccggccgacatgtcactttatattcggccgcctgtgcgccacgagggttaaaaaacatggttgcccaccagttgccatccttatcctgaaacagattgttgtgtccgccgccggtaattgcgttataccgtttaccataaggaccatatacattgtcggcagtggcaatgatacaatcatagctataacgagttttcttattagttaacccttccttctcgacataagtgtcccccttcaccgtgcggtgtgcccagatagcttgtaccaaatgatattttccatcatatttaaagatgaatgctccttcaacatacggctccggagagtatttactttcttttaatgtctttatctcttctgccaaaccactcatatctggtttcatgcgtgctatatagtggttgtgaccgacaaaatatacggtaccatccgtatcttcaaacaggcttccgtcaatgtttggaaaaatggctttatcctcgttaccttcgatattttcataaggtccctccggcttcccggtagtactccgcagaataaaagagcctcttccgcctgccgattgattcatgcaggctacaataaaccaatttttcgcactctttatatagtgcatttccggtgcccatacagcgtggaaacggttatccatcggatcattattgatagacttcttcgcatatttctctccctctttatatactttgggatctttctgccaggtaccgtctttttccattgaccagattcgtcccatggcttcccatatcttcaggtctttggagcgccaaagatacaaaccgtcattccaatcccagcaatgtctctgtcccggaaagtgacggtcgggggtagaagtggttccagtgatatagtagtaaccgtcggggcctagtgttgcccatgtgtcacgcatccagtagtcaaatgccggttgaacagattttgggacacgcagctccggagcgtttgtatcagcagttccatatgcttgtgccgatgctgtgctgactgagacaaatcctgtcagtaaagcaagtcctaatcgcaatataaatttcatagattacagttttattatttacggatacaaaagtagactgttacaggattgagctcatggaacaatgtctttaatatccgtcaatatgtacattcttttgatttattattgttcgggttggagataattataaggatcctgtttaaaatgataacgtttccggggaagagggagtggatcctgcagacgtaattcccatgcgactaacttcgtcagaagctctgtctgaacagcagtgtatttctttttaccaaacaggttatctacttccgaaggatctttcttaagattatatagttctccgtttccatagttatccatcaccagtttccagtcgtcttttctgaccatacgagaggtaccgctttgagtccaggtattgagttcatcaaagtatgcaatcttacccggcgtcaatgccccttcctgttcgaaagtaagagaagaatccagtccgacatgtgctcctccaaaaccttgttgtacgacaatgctggaaaactcttctttggggtattcttttccggtcaacatcggccataagctacgaccttgaacaccagccggaatcttggcaccgattgcagaacaaagagtaggaaaaatatcagcaattgacacatggctatccataggggctgattgattcttgacatgatatcctgcccataccatcgggatacgtgcgagactttcagaaagtccggctcctttgcggatcaacccgtattctccccaataatcgccatgatctgaaagaacaacaaagattgtattttcaaactgcccgctggcttttaacgattcgatcagtctctttatctggtcatctattaaacggatcatgccgatataattagcacggattctgggtaggtcctgttccagattaggacaagacgcatcttccagttctgctaaaatgcgatatttctctcctttcttttccaagtctttacgtgacgtcttcaatacgggaagcttatccggcgaaaacatagaataatagggttcgcaaacctgataaggattatgaggttccgggaaagatacccacacaaagaaaggattctctttttgactctctatccatgacaatgtctcattaacgattttagcagggtgttgctcctctacaggaattggcgaaggttccagccattgtcccctggctttctggtttaagaaacgagccgtctctttttcttcgggagtcgttttcttatttttaccccaatgcccgtattctgaccaaaagtccaagtcagcaggtttcagataagcatggtttttacctacaagtgctgttttatatccgttttcttttaatacgcccaccaagtcctgttcaaaaaagatatccggaatgttgtggttggtacgtacatgggttgccgaaggaaaacgtccggtgaacatggagcagcgggcaggagaactggccggtgctacagtatatgctttgttaaaccatacattttcctgagctaattgatctacataaggagtaactgccagaggaaaaccttctctgccacataggtcagcacgctgctgatcggtcataatgattacaatattcggcttgtcggtttgtgccatcaatgacatagacaaaccctgtaatgccaatcccgtaatacaaaacgctgcatttctcatatttatcttatttaaaacggtatacaatcattgaagaagcctcaagctgcaaatctttatttaagtccagtgttacggtcgactgaactggctttactgcatccggcatttccggagtgttattcttgccgggttccagactcaatgttattttttgtgcctgtatctttttcccaaatcctttcactgctgtttgaagtaccacctcctgttttctcaaattgatcagtttcaggatatattctttactttcactatcatatcccatcgtaacaaagacattctgcaaacccttcatcccctgaatcccagcatccaggcatacatcgaaagtgtggtctctgaacatttttgataaataatagaaagatgtcctgatgctgcaatctaccccattgattagcatagagtgcaactgacgatgctctgaaaaatcccaatggcgcatcaccggacgttctgccaataatggattcaagtctccattacgttcaagagacattcgcaccgctccgctggctaacagattatagggatacttcccgtcaatgcccaattctccaacaaacaaatccgctattccccgttcatagttgtcaaaacggtaatgctgcttgcaagcccattcgacaggttgataatggtgttcatcgaataccttcacattcttcgggttcacaaacttcgcaatatcaatccgtttgtcgtcattttctttgcctatgatactgttggctatgtatatcaagtcggggtactgtctgtgtaacgcttgataaatcttctcgtaacgttcccaataaacaggtccgaagtcttcgtttccaatttcaatgtactttagagggaaaggcttcggatgtccgttctttacacgtaaagccccccatttgctggtttccggaccgattgcgtattctatggcatccagtgcatcctgaatataagcatccagatcaacgtccggttgaatgaaattccagggagaactttgctttacccaacctgtacagatcatccctgtagggattacgtacatagcatctgctcccaaatattcgcacaattcgtaaaactcatgataaccaattccatctgtacggtagtaaggcgcccatttactccattgtcccggtcgattttcaatgggacctattgtctttttccagtggtacatggtagcttcattcaccccatgcacaatacatccgccgggaaaacgaatgaaatccggtgcatattctttcaagttctgcataatatccgcccgaaaaactgattttccattgtcccatgtatcagaagggaataaagagacgacatccagttggaattgccctttacctaacggctgaatggcaagcatcccccgtttgacatctttatcaggttttaatgttccggtaagtttcgtccactctttaccctttacatccaaaacaagctgagtactgaccggtttaccttgttcgtctaccagcataacttgaagaagagctgtataatttttgctttttatatacatggaaagatgataagatacctcctttcgtagattcataccgtaatatccccgatttagaatcattgcctccggattgtttgcaatatcttcagtcacgttgaccagcattgaatacttattctccttattcagaggattttcttctgtacggctaatgaaaatgggagtataagacagaggataagtgttccatccgatcagagggtctacatgaaatacatctttgttttttccacgcggattcggtacattctgataaagcccatttttgaccgccagatctgcgggtggagttgcttcttcgaatgaacggttgcgtaccagttcggcatgcaaggcaccttctcctatcataccaatctcttcataatggaacccatattggacacggcttactttgcgtgttttctgtttgtcgatatgcaaaacaccctcatgagtatcatttacctggcttcctgttatcggctggataaacataaaacagcacaggcaatacactgccgttctgcaaaattttgttttcatggtcttttcatttggtttacgatacaaatgtagagaattcaaagaataaacattcgtaacatcatgttcaatataaggaagcatgtattgtttgagcccataaagcttcgattgtgcacataatttctaatggaatatacatttgtactagaaaaaccgatagaaaaaagactatctttgagcgttaaacaaggagtagaatcagatatgaaaaggagtacactcaaaaatcttatatcggtagcagtttgtttattattcctgcttcatccgacatttgcggaaggaaaaatccaatataataatgtccgcttcaaacagctaagcattacagaagggctttctcataatactgtcaatgccatatctcaggacagtaagggatttatgtggtttggcaccaggaatggattatgcagatatgatgggtataatattacccggtactttcacgaagaaggggattccactacaatcagccatgattttatcaccaaactatataatgacccctgccggaatgtcctctggatttctacggagcaaggaatctgcaaatacaatccccagaatgaacaattcacacgctatcacatagagggaaacaataagaacagtgtcttatttctgaacacgtctgacagcagattgctgaccggatgcagtaacggcatctatcaatacgataatgaaaaaaacagcttcactccttttatattaaatgaaggaaaaggagaaaatattcgtggactggtagaagactcaaacaatgttctatggataaacagtaacaaaggggtgaaacgctataatctaaagaaggaacaatttgaaccactgcctctgaacatccgtccatttttggaaacgtgcattcaattagttatgttgcctggcaatcagttgttattcaatacacctcaagaggtatttgtgtacaatatcaataatgattcgctgtatcctctggccgcgatcaaggatatcagacaattcagatgtgcaacaactgatactatgaacaacatctggctgggaaccgaaaatggaattttcatttatgaccagacctttcggttagtgactcactatcagcagtcggaaagtgacttgagtaatctgaacgattctcctatttatagcctttttgaagattacaatcataacatgtgggttggaacctatttcggtggtgtgaattattttatatatgcttcggatcagttccggatttatccttatggaaactctcccaatcatctgagtggtaaagctgtacgccagatcatcaatactccggacaacgggctctatattgctaccgaagacggagggcttaactacctgaacagcaatcgggaaataacgcgttccgaacgactccatgaacggatgaatataaaagcccggaatatacattccttgctgattgacagtaaacagaacctatggatcggtctgtttcttcggggaatgaactattatatgcccaaagagaacaaaacgctttcttttaatgacggaatggggaaaaactcatccgggttctgcatcatagaagacgaaaccggcaaaatctggtatggagggccgtcgggactatttaccttgaagaaacagaacggcagtttccagttgaaaaaagtttctgcacttcctgtcttttgcatgcttaacctcaatgacagcattatctggactggaaaccgtcaaaatggaatataccagataaacaaacgaacagaagaacagacacctcttccacaattctcatccagtaagttgtatatgacttatttatatatggactcgcaggggaatatttgggcaggaacgaacaatgacgggctttttgttctgaataaaaaaggcgaaaaattgaaaagttattcgaagaaagaattgggatcgaacgctataaaaggtataatagaagatgatcagaacactatatggataggaacagacaacggattatgtaatattcagccgaaatccggattaatcagccggtataccatagccgacggactgccgaccaatcagttcaattattcctctgtctgcaagaaacccgacggcgaactgttcttcggaacaattaatggcatgatttctttctatcctgaacaggtgcgccctgtagaacctcattttaatatcgctttgacaggagtatggagcaataacgatgtcgtatcttccagcaatccggatgcgctactgcccgcctctatctctgaaagtgatgtgatgacgcttacccacgaacaggcacaatccatacgtatcgaatactcagggcttaattatcaatacaaagataaaacgcaatatgccatgaagctggaaggcatcgataaagaatggcagtttgtaggcaatcagcatcaggtacgtttctctaatctcccgaccggagattatacattgaagattaaagcaagcaatgacggagtaaactgggatgaaaaaggacagaaagagttgactatccatgtactacctccgtggtggctttctatatgggcctatctgacctacgtatgtatggttctctgcatcatctatttggcatataaatataccaaagccaggttgattcttcttatgagactgaaaacggaacatgagcaacgggttaatatggagaagatgaatcaatcgaaaataaacttctttacgtacgtatctcatgatctgaaaacaccgttgactttgatcctgtcaccacttcagcggctcatcaaacagaaacaaatcgataataatgatcgcgagaaactggaagtcatctaccgcaatgccaacagaatgcattatcttattgacgaactgctcactttcagtaaaatcgaaatgcagcaaatggaaattaacgtcagaaaaggaaacatcatgcatttcctggaagagatttctcatatcttcgatattgtatctaaggaaaaggagattgatttcattgtcagtctggaagaaacggatgaagaagtctggttctctccatccaagctggaacgcatcatgtataatctgctgtcgaatgctttcaaatacacccagccgggagattatgtgaaactcagtgccaagcttctcaaaaaagattcggaaaatttcatcgaaatatcagtaaaagacagcggcagagggattcctaaagagatgaaagataaaatctttgacagctacttccaagtagaaaaaaaggatcatagagaaggcttcggattggggttatctctcacgaagtcactgattcatatgcataagggggagattaaggttgaaagcgaagtcggaaagggatcggaatttatcgtcagcctgaatgtttcagaatctgcctatagctcttcggagaaatctttggaaagtatcacgtccgaagaaatacagaaatataatctgcggatgaaagaaacgatcgaactgattcccgaccagttgatttctaccgagcaagataacaccgacgtcaaagaaagtatccttattgtagaagataataaagagatgaatgattatctggcagagatatttagcaaagattatcaggtatttcgtgcttacaatggtgctgaggcttgtaagttactgaagaagcaactgcccgatctgatagtcagcgatgtaatgatgcccgtgatggatggtctggaattaacggcatacgtcaaacaggatttgaatagcagtcatatcccggtaattctgctaactgctaaaacggatgaattggatcatactcaagggtacttgaaaggggcggatgcgtatataaccaagccttttaatgcacagaatctggaactattggttcagaatatgcgtactaacagaaagcagaacattgagtatttcaagcggatcgagaagctgaacattacacaaataacgaacaatccacgtgatgaagtatttatgaaagagttagttgacctgattatggccaatatcaaagacgaagagttcggagttactgaaattattactcatatgaaagtgagccgaagcctgttgcataccaagcttaaatcattgaccggatgttctatcacccagttcatgcggactataaagatgaaagaagcaaagattcatttacagaatggcatgaatgtctcggaagcttcgtacgccgtaggaatgtccgaccctaactattttacaaaatgttttaagaaagagtttaatatcactcctactgaatttatcaaacaactgaatctgtaaattaaaaaacaaacttatatctaatgcttattaatatttaatacatgaaagtacatgtaaaatgaaaacatttagaattattgtattgctattagttctaggaattaatgctacagcacaagaaaatcaaaattttgctaagatactagatacttatgtaggtacttgggtttatcagaaaaatgataccgtatttaaaattaaatttcaaaaaggtcaacagctatggacaaaaaaaaccgcaaatggactttatggaggatattatctatcagtcaatggaagagtattggaagattatatgggagaacttcctacgtgttgggatgtattaaaagagtgtcagcctaataatttgtttatatgggcttacagtccttatactgatgaattaggaagtttaggtataatattttatgaccaacgtaaaagacactttggtggtaaggggattacaggtggatacatacagttattgtcgcctactaagattcgctggaaactggatgaggaaaaaggaatttggaatgagacagaaggtgatgaatctattagtgacgcaggaaggagaccaattggcttttctgtcccagatgacgttattatgacgaaagaataagtattgcgtggaatgtgtattgcaggaattatatgcccgacaataatttttcactaatagtcataggttataattagatgtaactaaaaatgcaagtacatataaaatgaaaacattcaaatttatcttattagcattagttgttagtaatactattacagcacagaagaatgtacgtcctactaagaatttggattcttatgaaggtacttggatttatcaaaagaacgatattattttcaaaataaagctacaaaaagggcaagaggcatggagaaacgatctaattaacggactttatggaggatattatctttctgttagaggagaggtattagagaactatatgagtggattccctgtatattgggatttttcaaaagaccctcgtcctaataacatgtatatttgggtttctaatcactcacttcgtttagatgatatcaatcccaattatgttagcgtttggttttatgaccaacgtaaaagacattttggtggtaagggaattacaggtggatacatacagttattgtcacctactaagattcgctggaaactggatgaattaacaggtatttggaatgagacagaaggtgatgaatctattagtgatgcagaaaggagaccaattggcttttctgtcccggatgacgttattatgacgaaagaatagatgctattcacatatgcagttgggcataagtaatgctggagaaagggtgtttcattatgaagtaatgtcatcatatactttggtattactacttccattattattaggctatatacagcagcaaacgtatatgtttgctgtccctttccattgcttccatatggtgtctttatcgtcttattattttctgcagcataggcttttcatcaaggattttttttagaaggaagcttcccgacaattatccaggttatcttgggagaagaatacttctactttgaaatttattgattctcattttctgacctaactataaatgatacagagagataaatgatagtataaatgccaccaaaatagctcgacaacttttttctcaaaagttgaaagtagataatttattggataaagagttcctatgctaaatttagctccggcttgtgcaataaataatcctttgcagtgcataaattaattcgtccgcctatagccggacgcaagtttgcctatagccgacgttgcgtttgcctatagccggacgaaacgttgtctataggcggacgaattaatttatgcacctgcggatattattttttataaagaaaatgtttattgtattcgacagcaatgattgtagtggttgggaagcagattcagaagcgaatcagaaatgaaccataataaagaggaaatatccaaattctaagtgttttttaatatgcaaacagcttaaatggaaaaatccccgataaaaaacgactggcaaatcaaaagcctctatttaatatatcctaaagatttcaagaagaccacagtagctgacatcgttttttcaaaaaattcttcaaacttagcattaaagaaaccgtgcttttgtcccggatatagcaataaatcgcaacgtgaccctacatgttccattttcttcttaaactttagagccgtttcaagcaaaacaatattatcctcactccctaaaaaaaatatagcaggaggagcatctttttttatattatgtataggagaaaaatctctataataatcttttactctgtcgaatccgtacccatgaggtccattatctataaccggattaaaaaggatcaaagctttaggaattgatgacacattaagatcatcctccggattattaatttgatgacaaaaagctgttgcagcagccaaatgtccacctgcagagccaccgcctgccaatattttatcaggatcaacatgtatggacattgcatgctgctttaaataacgcatagctgattttgcatccattaaagcttctttaggagtagtacctgcattcttttgggttcgataatcagctaatacaactgttactccatacttattcaaataactggcttgtgattcaaattgtttaggagaaccggaattccaacctccaccaaaaaagaaaataacagccggagaactctgattcgtttggtccttggaataataaacatagagtttacctgtaggatagtgattatatctcaaaatcgtatctgcacttaaatcattgttatctctaataaacaggttgctacctattaataggtttccactattaataagaactaaagataatgttacaatagcctttaattctatacaccgtattagtttaattcgcattattatactttttatcatttcattcaaattaacaggtttatttatatctgtcattggatagcgagataacttacctcatcaatatcaaagataaaacatttatcctcctgaatccattgtcccataggatgaagaccattagaagtatctacttcaatctgcacactgtttacaaatcacttttgtttggaaggcatatgatcaaacgcccgcatttcggtagcttgcccttcgtctccacacgctttcatccatttctttagttctgcatccagccgaataataatattggagtatttcgtatctcctgccaaattgttcatgcaaaatggatcattccgtacgtcgtacaattcaatggcaggacgatgctgatacttgaatgtcatcgcctttgcatgggcatctgtctctgcaagctgtttccattctttaaataaaggcgtagcagtcatcgcattctgaaaggttgcctccggagtaaggttaacaatatatcgatatcttccatcataggctgagcgtatcccgtagtactccggacctttatttattcccctgctagtctgaagagagaaagaatatttcttatgctccttcttcttccctgtcaaaacagatttaaagctttcaccatctactctcgtctgcggttttcctcctgctatatcgacaaaagtaggaactatatccacatattctactaatgcatcactgacactccccggtttgactactcccggccagcggacaatgcatgccgaatgtacgcctgcatcataacaagtccatttggcaaaaggcagactgtttccttgttcactcaaatatactacaacagattgatcagcgaccttttcctgttccaaaatagagagtacgttaccaaactcctgatccataaagttgacttctgcaagatacttagtaaactcctgacgtgtttgtggaacatctacatacataggtgccaaagttaatttatccggatcgaactgtgagacatcacctttattccaaggggtatgtggctgattggaagcaacaaacaggcaaaacggctggcctttccttttgcaatcagcgataaatttctgaatagcttcaaaatgtaattcccccttttcactaggcacgtagagatcaaagggaaatactgactttggagcaacatgcttctttccaatcaaagctactttataccccaatggatgcaaatgatgcacaacgcttaaagtaccctgatcagcacaagtatggtttggataagctccgctacccacaggccataaacctgtatacagattatggcgggtaggcgatgacataggagcagcttgataggcttgggtgaaacgcactccctgtgtggcaaaattatctatattaggtgttttcgaatccacacttccatagcaacctaaatcgtaatatgaacaatcatcggctatgaacaacaccaaattaggctgcgtgatttgctgtgcaaaagagcaagttgtcgcacttaatgcaacagaaacactcaaaaatagtctattcataatttatttctcctttcatgggagtgcttaatttaaacatatatctttagtatccgggattttgttgtactccatcattgcgagaaacctctgcaaatggtatcggaaaatatttctttcttgcagccataactccttgcttttgtacatccgcagccggtcgtgatgggatgaatgtatcctttatgtagtcatacatctgcgtgttttcatcatacttcatacgaataaggtcgaaccagcgtttctgttcaccggcaaattccaatccccgttccatgaataccagccagcggaattcttgtttggtcaaggtacgtccgatattatcgggtctgtccgaacctatatacttcggataagcacgttcggttccgttcgctttgcgcgcacgttcacgcaccatatcgatagcctgacaggcttctgtgtactttccaagttcgttcaatgcttctgctcttataagatacatatcggacagacgcagacgtggcatatcgttttcattggtacggttattgataccttgcggatcaataaatttgcggatatatccccagttctcctgtgagtttcctccggcagcaggatatacggttacgatattgcccaatactcctgtattattgttcttttgttgaaaacgtctccagaatgtaacctcaatccggtaatctttagaaatgagtttggattcatcaatggatgcatcaacagaggggtcactgtatcctagattaccctgatcgtcctgaaaatatttgataaaccatttttgtaccctatgagctcctgctccttttccatagggatttccagaaaccaatttaccaccaacctgcacacctgccggattaaataaatgagcaatattagaacccaatgactgatctgctaaagcatctttgtcacgaaagaaaggtactgagaagatatgttcggtttgagctaatgactcttgctcaatgtcccataaattctgataatcattgacaaacgtatattgttcggaagaaatcacctcttgggcttctctggctgcatcctcccatcttccgagagtcaagtagacttccgccaaaaatgcatgagcagctccgttagttacacgtccgcttgtgtacgccggatctaaacgtttcggcaaacggggagtatcatcatcgttcaatccggcggcatattcaaaatcacttattatctgttcgtaaactttagacgcgggagattgtggtacatatgcgttttcaattccggttacaggctcaataacaataggaataccattaacaccaccatacaagcgcattaagtcataatgataaagtgctctcagaaagtaggcttctgcaatgatccgattcttatcattttcacttttgaaggaaatagaaggaacacgtgctattacttcattagcatttttaatgccattatatagctctccccaaaaattaacaactggagcggaaccagcactgtgtgtattgttggaaacagtggcaggtacagcgtttccggtagagaacatagcgtcttcataggtcggaagtatgatagcccagtttgttttatgataagcgaaagcgtaaagagtggagtataccccgttaatagccgccaaggcatgatcttccgttttgaagaatccgtcctctttttctacacggtctacaatatctacatccaaacagcttgaaagcagcgctgttcctatcagtaaggataatatatatttcttcatattttcagtattttgatgttaaaaagctagatttatacccatagaatacgtacggctagaaggataagcagcatagtcaacattaggtgacatagcgcccgaagtaatgctgacttccggatcgtaaccgctataattagtgattgtaaagacattggtaacggtaccgaatacacgtacactacgtaaccatcgtagttttttcaagctaaactggtaggcgagtgtcagattcttcagacggaaaaatgaaccatcttcaagcaagaaggtagagaaacgcttgttaaagtaagaactgccttgcgaaccgtttactgccggataaaagttactggttccttcgccctgccatcttccttcccaagcctcagcacgaatattgtcgttggtatctgtaaaagaatccaagaaataacggttcaaattggcgatatcacctcctacacggcccgtgaaaatcatggataatgtcaggcccttccaagatagctcagaattaataccataattgaatttcggttctgccgtaccgatgatagtcatatcgtcagaagttatttttccatccggcagcccgtcgggtccactaatatctttgaatctcaaagaacccggagtagcttgtggagtatcaaatggagccagttttgcttctgcttcattctgataaacaccatccactacgtagccatagaagctgcctaccggataaccggctttagtgatatgtatgctttggctgaatacaccgccacctgcaagataggaggttcccagtaactcattgccgctgatatcgtctactttattacggttcaggtatatgtttcctccaagagtccattttacgcgacctgtcagaatatccgcactggcttccagctcaaatcctttattggtcatttttcccatattgtaaggtatagaaccgtatccggatgataaaggcagtccaaaattcatcagcatatctttggtagtacgttgatatacattcatggttactctaaaacggttgtctataaaacctaaatccagtccggcattgtaggtagcagtactttcccaacctaaattaggattagccagcttcccgttgaccataccgtgagtcactgcacctccggaataagagcggacatggttcataatggcgagcggagcagcataagcaatgctttggttacctgtaacaccatagctcaaacgtagcttaatattagagatagcaggtatgtctttcatgaacttctcttgattaatgcgccaggctactgcaaatgatggaaagaaactccacctgtttccacttgccaacaaagaagaaccgtcgtagcgtccggttgccgtgaaaatataacggtcatacagggtgtagttcatacgtcctaagaaagaggaaagtttagtttgaatgactgaactggatttgtccatcgtattcgttccttctccgatagcgtagtacaacaagtcattgcctgcaaaatcacctacctgaattgccagtgtctttctctgacggtcttcatgcgtatatcccaagacagcattgatgtgatgatgcttcttaaatttacgatcataattaaccgtcgtttccaatacaatattctggcgattgtcttctccacgaaatgccataccatgggcactgtttccagcattggtacctattggataataagtagaacgcgaaccgtctgtgcggttgaagctaccggcacctttccaggaaagccctttaccaaagttatatgtcaaagatgcattcagtatgaagaaccgttgttgaagaatgtcttttagttcggtcgccataatataaggattgtctgccggaacatattccacattttcatcttcataaatttgatctccaggcattaatgtcggtttggtagtcaaaatacgccgtaccatttggttcatacttgaagattgagagtgcgacgtttgcttctgctcagtctgtgaataacttgtgttcagttgcaaaactaaacgcttggcaagctcagatttaagattcagacggaaagaataacgttcgagtccagtattcataataataccttcttgatcggtgtagccggcagtaatattatattgagtcatcttgttaccaccattgacagccaactggtggtcctgagatactgccgtctggtacattaagtcctgccagtcagttgaataaatcttatatctttccaaggcatcatctgtatgtctggggacttttgtacttggaatgacgtttccttgcatatcgtagccgttagaggttcgatccaattcattctcaaaaagcgcatagtcatgagcattcagtaaattatagcgtttggaaatgttggaaatatctacacgggcattgtaattcacattgacttttccttcttttccctgtttggttgtgatcagaataactccgttcgtagcacgtgaaccataaatagccgttgcggaagcatctttcagaacctggatagattcaatatcattgggattgatggaagctagcggattcatcgccggctgttggctcaactcactggtgccaccatttacacttgctgttgcagcctctatcgggaaaccgtcgactacataaagcgggtctgtattgcctgacagtgtagagacaccacgtatttgaatattcatgcccgctccgggtgcaccactgttagctgcgatactgacgcccgctatacgtccctgcaaaaactggtcggcacttgtgataggcataatctcagcttcattcttcatactgacagcacttaccgaaccggaaaggtcggatttacgaacagttccatagccgatgaccaccacctcgtccaaattgcgtgatgcttcctgcattgtaatcgtcatcttcccttttaactgtaccggaacagttatagtagtaaatccgatatacgatatctgtaactgggccttgggattttttacttccagcgagaagttaccgtcaatgtctgtaatggttccgttgttagcacccttcacttggattgtagctccaatgataggagactttccttcatcaactaccacaccggaaattttatgagactgtgctgatacggttgatatatatcctaaaaagcatattagtaggactaagtatctatccgtcaacttaaatcgaatcttctgtttcataatattatattcgttattcattgattgttaaaccttattttaataagccctgtaatgtcgggtattcacttcccatttcccaaaccgtactgaaattccagtttgtgaatgaagatgtgttcttcatttcacttgcagacaggttcttataactggaagaaccacctgatatgtatgagtcacttccgctactctgtgactttccgtcttcgttcaaagagaaacagcttttcattgttatttgagaaatcttgccatcagtacgatggaacagtccgtttccgaaagaagccccgttcgcagttgtcatgtctcctacgttatgacagttttcgattgtcatgccacctcctgctgctatagtacatgtcgctacaattcctgcggcattgctgttgccattggtagctgtacctgtgctctttatcgcacctgtattgtagcaatctctgactatagcattggttccacccatacgtgcgatgataccacttgccgagcccatcgcagtgatagaaccagtattgtaagactgggatatttcggtatcaatagttgcacgaccgacaattcctcctacttgattgttagcctgagttccagaaatttctcctgaatttgcacaaccagtcactttgatcaggtcatttcctgctgctcccgctattgaaccgaccacacctccaaccggtgatttgctgctgcaaactacattcgctttattggtacaatatgcaacggcaggagcattgttagcatcacgcattatgattcctacaaccccaccgacacaaccggctgtcccttcaatagccgctgtattagagcaataggaaacttcgcctttctcggtgagataaccgacaattcctccgagatagatttcagcatccgtagttgcagccgtactgatgcttccctcattacctgttgtgtggcaagagataattttaccagaacagttaccggcaatcgcaccaactttggctttggccttgataacaacattctcgatacatacattacgtacgataccttctgcaccgatagaagcgaacaaaccgcaattagtattggaacttttattcagcgtccagttctttatcttatattgttcggaagaacgtcctgtaccggtatcgataatatctcccttagttgcttcgtatactccggtgaaattaccgttataagtgttattgaccagttctgtactgataggtgccatatctatgcctgtaaggtcaatatctacagtctgtttgtagttcttatcaagatacttgctgacgttcctcaaatgacggggcttcgtgataatatattcagatcctttttctccgtctccactggtctcgtcaaacagattgtgtgcctctataatttcacttcccatctgagctacagttcctccgccaatgtttgcgtaagagaataactgaatagaaaccattcctacatatcctttccagtcaataacatccagattgtaagatgccgttcccgaaggaatatcgattgtgttttcgttctggtctgcaatgactttcagcttatagccgtccacaccggtaatttcattccatgaaagcaggaaatcgttgtgatcatccaaagtaatgacaggagcttccagtttgtcggcctgaatgacaggaatactcagactcttgtcggcagctgtaaaaaccaaactggctttacgtaccacttctgtcgtattactctcggtagtgactttcaaagtggctgttccttttcctgtaacaggagttactgtacaccatttaaccggagtatgggtcggttcatccactacttcgacattccattctaccgcattggtttgtagagtaatatccttttcacctcctccaatgttatattgcagttctttagagtccgcagccaaagaagtttcgctggcttcttgctccacagttactatctttatctcctgcgattcattgataagaaaagtcagttctgccgtacgaggttcattccatggattctcagaatacgaaacaggcacttgggaatatttgaacccttctgtttctgatacgctgcaccatgcttgtgaactacttaacgtccatttatcatcagatatcactttcaatatataggttccctctggtcccggtacttgtagaggggactgagtgagctcgtttaaggtcaaataagtttcagcgacctttgcatccggttcgggatatacaatatcttcttgttgacaccccgcgaaacatacagcagtcagcatgatgacggctagtttacgatacttatttttcatatgttataaattaaagattataattccgatacttcttatttgagatattcttctacaggagtataccatttgccaaccttgaattcgatctcactttctactccgatatgatctgccattttttggtaatcatgaatcattcggttcagtatttcaggctccctatctgcgagattccgcatttcagtaggatcattcttcaagttgtatagcctccatttcggctctttatattcctgcactattttccattctccgtcacgcagcattttgttgccttcgtgttccacaatggtcggtttggtttgctttaccggttctccctttaataaaggcagtaaggatataccttccattggaggtactttatggccgccacgcgaagagggataagtagcgcctgtaagtttcaccaaagtaggcatgatatctactatatgtccgtaattgtctttttgaatagtgccgttcagacttttatcaattccattcggataggaaacaataaacggtgtgttgcaacctccttcatgaccgtgatgtttgtacaagaagaatggtgcattagcaacgtctgcccaggcagcacccagaaaaactgtactccccgctgaaccgggattctttccagcaaagcgtccttctatgcccggttctccatttccaccattgtccgaaaggaggataatcagggtattatccagcacacctttttcttttaaatgttctaccacacgcccgatactccgatctacttcctcaataacagctgcataaatagccatctgcatgtcatagcgctccttttcttcctgagtcagtgaatcccattccggaaccttgggattacgaggtgttaactggtcaggacgctcgaataaccctaattctaattgctttttgaatcgtgcattacgcacatcttcccatcccttcatatattttcccttatatttattgatggtttctacaggagcctgcaagggaaaatgtgcagcattatgtgccagataccaaaagaagggctgtttttcttcaatagcttcatcaataaactttaatccaaaatctgtccacaaatgagtagaataccaattttcaggtaaacgatcatcatcgaatccaatttcttcatcattcaaataaagatttcgttggttggttctttcttttttattcttcttcaatgatttgtcagaagaaaaataatagccgccaaacggagcgttcagtgaacggtcaaatcctctgcttattggagtaacaccttgaaaatatcctaaatgccatttacctgtcatgacattaaaatatccagctgttttcaatgcttcaggcaagaaaacattattctcatttggatatccctgatatgccggataacccggaactttccctaaagcaccattcccaacttgatgaggatataaaccagtaatcaacgaagccctggttggcgcactccgagcctggttataaaaatgacgtagtctaataccattttcagcaagccgatctatattaggagtatttatttccgaaccataacatccgaaatcggaatatccgacatcatccaataatataaggacaatattaggttttgatacattctgctgggccaatacaggacaagcacctattgacgcaccaagggtcaacataaaagtataatctattcttttcatggctatatattattttttattattaggaaatggaattaaaacttttgtctcagctgcccatacggcccatttgtccgataactgtttaaggatatccggatgaacggctgacaaatcacaagcctccacgcggtctttcccgatatcatataattcccaaacttttccttcctgatcccataccgctttccagtttttccaacggacagctctattaccctgatgttcccaatacatatattcatgaatggaagaaacttttccttttatagccggcataagatcagtgcccactaaaggatgtatcttattaccattgtgaaaggtagaaggatatgtggcaccagttacattcagtatggtcggcatgatatccggaagatatccgggaacgtggcaccatgtattttcaaaacctttcaaacgatttttccatgtaattatcaacggagtagatattcccccttcgtatgcacgttgtttgtactttctgaatggagtatttgaggtctgagcccaagctttgccatacgaaggatggccgcttaccgccggattattgatatctttttgcttgccaccaccaagttcattatgcggttcggcacatgccccgttatcagacatgaaaaagatcaaagtattatccaactttccactctttttcaggctctcaatcagttttcctatgttataatccatacaatgcacttgtgcagcataaacagccattctataagctgtatgatctttttctgcttcagagagctcttcccactgacgattctcccattcagcaaaaccgatctctgagtcgattattcctaaatcggccatacgtttatggcgttctttacgaatctggtcccagcctttcgtacgatacagttcataatatttctctatatctgcttctttagcttgtaaaggccaatgcggagcattatatgctaaatataagaaaaagggagtattatctttttgttcatttataaaattaacggcatagtctgtaaacgcatcggtagtataataaggtgcctcgggtgcaggtaacttttcgttgtctaggaccaatcctctttcaccttctggcctcagataactgcaagcccctgccaatataccataaaaacgttcaaaaccacgctgcaaaggccatttttccatgccatgcatccctaaatgccatttgcccgtcatataggtatggtaacctgaacttttaagaacttcggcaatagtcacacaattacggttcaaagcccccctatattcagcaacaccccagtctttcggatctttatcgacatttttaaaaggatcttctgacatccatcctatcccagcttgatgttgatacaaaccagtcataagacttgcccgggttgggcaggaacgagaagtattataaaattgagtcagccggattccctgtaacgccaaactatcaatatgcggggtttctatctcgctaccataacatccgatatcggaataacccatatcatctgccaatatcataactatgttcggacgctcttgtcccgagagatttccaaactgtaaaaaggataaagcaactatgcctcctattctttttcgagatataaaattaccatccatcataatacatattgttttatatacttctattatttccacattggcttgataacattttctttatcaatcgttatactatatacgtcattttccttttttaagattaacggaacaatgcgtgtcttacgcggctgcacaattgaatctgaatgatgaacatgatatacatagtaatatcttccgtccaaacctttaaacaaatccccatgtccggagccgttttcgtggacgatgcttcggtgaataataggattgtttgcatgcttcttccacggaccgtaaggagacgtagacgtagcatatcccacagcataatctatattcttgaaatgattggcagaatagaacaaataatataaatcatcgagtttgacaacagtaggaccttccattactggtgccgatttataattaggcgttctttcccatgcctccgtattatcgaaacactttttcagagtttcgggcttaatacagcctttctgcaagtcaaattcagctacccacagataatttcctttgttgaaacgtacatgatacaagtagtactttccatctgaatctttgaataaaaatgaatcgatatttttggccgtctcgtcaataggacgtatggagtcttgtctgaatggaccatatacagagttggaggatgccagtgcagtatgttcattagccgtatatgtcagataatacctatttccttccttaaataattgcggagcccagaatcctctttcaccataagcggaatctcccttgcgtagtatcaactgaagagtatctccattagcagtcttccattccttcaaatctgtagattcgaatatagcaaatccattaggttctctattgcgcgtacctgtgagataatacttgccattttctacaaatatagtcggatctgcaaaggtaatttcattcaatttatcgtctgttttttcttcttttgcagtcttgcaacatacacaagctaaaatggtgaatgtcgccaataaaaattggatgagtgttttcatatgattctaaaaagttaaacgttatttatgtatgattgtgatgcagcaaaagtaaaagaaaaaaggtgtagacgatagaaaatatgttttattatgagcacacatgttcagaaactatccttctacaccaattcctgcaaaacaatctaatacctaatcaatcaaatgctttccagaaggggttatcgggcttattttaatggttcttcttccacctcactacgataaaatccatctgtttgcacaaaaaattcctgctttaaccgctcaagcagttccggatgtctgccagctacattagatttctgtcccttgtctgattttacatcaaacagactgaattcatccaagttccccaattcatttccggtcaggtttctttgcgaacctttataaggtggcatcataatccagtcaccactgcggtaacccagtctgccttgagcttcaataatcaaattttcacgagctttcagttctgttcccatgaatgcatttaaatagttgcgactatccagtccatccggcagagtggctcccaccatgcttcctaaagacgccaacaagtccatctggcagactagtgcatccgattttacaggctgaatctttcctttccaataaacgaataaaggaatatgtgtacctccatcgaacaaactatatttaccaccacgtaatcctccggcaggagcgtgcttgccagccagttcgggagcaccatctttatatccatcattcaaaaccggaccattgtcacttgaaaaaataatcagagtcttttccagaagtccttctttcttcaaataagttagtaattcacccacacaccagtctgcttccacaattgcatctccacgaggtcccatagtcgttttcccaacaaaacgttgatgaggcgcgcgtggcacatgaggttcatgcaaaccataataaagaaagaatgaagagtctctgtgttcagtaataaagttctttaccttgtctacaaaataatcagccatatcttcgtctttccaacgggctttcttcccacctttcatataaccgatacggggtattccatttacaatcgaattattatgtccgtgcgcccattgcattttcagcatttcgggattggatatagcagtcggctccccctcaaagttctgttcataactcacctcaataggatctgacggatcacgacctaccacatctccattttctacataaacagtcggaacgcggtcatttgttgccgcaatcagacaagagtaatcaaagccaatctcttttgctcccggcttgactgtctcattccaattgacatttccatttcccatgcccaaatgccattttccgatagctccggtcacataaccacactctcgcatcatctttggtaaagtgtattggctctcgttgataataagaggagcatcacccggaaggatttttgcatctttattcttccatggatacattccggtcattagggcataacgactgggggtagaagtagccgaagtagcatatccatttgtgaaacaaactcccccacgggcaagactgtcaatattcggtgtatgaatagtagttgaaccataagcactgacatcaccgaaccccagatcatcagcaagaatgacaatcacattcggcttttcttctacctgctgtgaagtgcaacctgctaaagataacgcaggaacaagatagattatttttttcataatattatatagtttataatgatgcaaatttagtcagtgcttatttatttaaatagaacatatgtttaataatagggagtaatgtccatccatatctataaatgcactatcttaatatacaaacctaacttcacatcaccccaatttaactcccttacgctatttgaagtaccccatatatcaaagaccaaattaaaaaattggagggtgactgttttacaaccaccatcctttgctggttattgttctaagttagtaattttattcacttttacttttgcgtttcaattgtaaaagcatctttttttcataactttgtcctctgtatccttattgtctttttctgtcggaatataacttaatgatccgggatacttcataacatatgcagattcgactactacaactagctgttttactcatttgcctgtccggatgcatcgatagacatacgaatactcccgcattttatgtctggaaaagcaaattgagtgcagaagacgcggatactgcttatctgaatacactcggagtccaaaagatatatgcccgtatgttcgatgtagacaataaaggaaatggggcattccctacggcagactattcgccttcttccggcaatcccgactttcagcaagaggtagtccccgttatatttatcaccaaccaaaccatcctgcaatgtcctgccgcagatatagaaaagcttgcccgcaattgcgccgaccggatagataccgtttaccgttcgcatttcaacaagctcccaaatgaatatcagttcgactgcgactggacggtaaagacaaaagaaaactacttcaacttcctgaaacacatccggaaactaaggaaaggagccctggtaagttgcaccatccgccttcatcaaatcaagttcaaggacaaaaccggaatacctcctgtggacaagggaacgctgatgtattacgcttcatcggaacctacggacttcgaaaacaaaaacaccatattaaacaataaagacgctgcttcatatatcaaagacgtcggctcctatccgctgcatctggacatcgccctgccgctctacagttggggaatagtgagaaatccgttcggacagattaaactgattaacggaatccgccaagctactatcggcgcacatcccgaatattataaacaaacgaaagaaggtgtctacaacatactccaatcgcactatctgggcggagtatgggtgaacaaagactacgaactcaaagtagaagaggtcagcccggaaaccttgctcgaagcggcccaactcctacaaaggaaactacgaaaagagaacagggaaatcatcttctaccatctggacaaagagattctcaaacaatattccacacaacaattaactaacatcataaacgctttctcatgaaatacctgaaacgttctatcctcacactcgccatagcggtgattcccttccactcctacgtcaacggatgcggaggcgattactacgattatatgaactactataatcttttcgaccaacttcttttagagaacaaaggtctgcaacctttcctcctgaccacagactacgcattctatggagaagacacgaatccggacgccgaacagcagcccgacgagaacctgaatgcgtggatgacattcttcaagaaaaacaacaccctgcaagagatggatacagcacagttcaaaacattgctctattccgcttcttaccagtcgttaaagcaaccttcttccccatacgtcatcgccctgaacaagacagacgcaggaaagcagaccctcacttacctacaatatgcaaaggaactggaaccctacgcgcaactatcagaaaacgatggctggtgggacatgaaacgtgccgcctccccttcggaagagacgtacgcccactacaaaaacaaagggctggaactctaccagcactgcccatatcatgaactaaaattaagatacggctaccagctcgtacgcttggcgcactatatgcgcaacaagaacaatgaagccatccgaatgtataacctatacgtgaaacctctcaaacaggaacattatatctactacgccgcccttgaacaaacagccggcgccctctacaacataggcaaactggcaaatgccaactacctctactcccgtgtgttcgaccattcggacaacagaaagaaaatagcctattccagtttcagaatccaaagcgaagtagactggaacgaagcgatgacctggtgtaaagacaatcgggagaaagcggccatgtacgcgctccgagggtataataccttctccaacgaactggaagaggtggaaaatattctcgaaatatatcccgaatccccctatatcaagctgctcgccatccgttatatcaacaagatggaaaggaatgtgctgacccgctacaatcattcgaatgccacagatgacacaagctcattcatgcagccttccggaaaagtacttgcagagtatgaacgcggacagaaggttatcaaagcagtgatgaatcaccccaaagtgagcgacaaagacttttgggctctctacctggcacacctgtcgttcctctgcaaagactaccaacaagcatccgcactcatcgactccgtccgaaccacgaaacccgaattgctgaaacaaaaaagccgtacacaattcagcctctatctggcacaactgaagtttatcggtacagacgaagaaaaaacgatccgccaatacctgcaaacgagtaatgccgatgaagatttcatcaacgaaattgtcggtcatctctataagatgcagaaggactacggcaaagcattccttactcacaaccgtatagaggacttacgccagaatccggatccgaatattatcaactcactcatgagtaatgctgagaaagaaaatgaccaagcactgttaacccagctttacgaattggaaggaacttacttcctgcgcatgaataactttgaagaagctgcgaaatggtttgccaaagttccgccatcttacagtatcactcactatgattacgattatgaaacagagaaatatattcctgtagaaatcctgccgaacgagttcaacggctattcaaaaatctccccattgatattcagtaatggattcaagagactgtttagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcgcacgagctgcctatatgctggccaactattattataacatatcccctaccggttactacaggaatattcccacgtacttcagagataattcctactgttggtctgcgtatggatcatacggctcggcagtttcaaaccgtattcccgattacagcaaagagtacaattacagggacttcacccaagaatacatgactatcaacaacatggagaacgcccttgccctctacgaacaggctgccacttactttaccgatcgtgaatggaaagcacgcgcattgtttatggcatcctcctgtacaatggacctttatgcccaaaactggtgggataactggaacaacatcctcgaccctgattttaaacggtcggatgaagaaaagaaggtggacagctatttctaccaactggcaaaatcctattccgacacgcagttcttcaagcaagctgtgcacgaatgcaaatattttgactactacgtaaagaatgaattctaattctcccaaccattatttataatatgagaacaacaacatttaaaactaagattgcagctgtcgctatgttactgacaggactgacattatcttcttccttgcttgcacaagacatttcgggcacttggcatggtaaactctcccttcctgccggctcgttaaccattgtattccatatcaagcatacggaacagggaacttatgtggcaactcttgacagccccgatcagggaaccaaagatataaaaacagaaacaacttcttttcaagactctacactgactgttcagataccgattatccatgcctcttataaagggaaactgaatgcggaccaaaccattaccggcacattcacacaaggaatgcccctcccattgaatctgacgaaaggagagtttagcggacctaaacgcccgcaggagcctcagccaccttttccttataaggtcgaggaagtcagcgtaaagaatacgcaggacggaatcactctggcaggcacattaacccttccggagaaagggagtaaatttccggctgtagtattggttacaggaagtggtgctcaaaacagagatgaagaaatcatggggcataaaccttttcttgttatcgccgattatctgacacgtaacggaattgccgtactaagatgcgatgaccgtggcacagctgcttcacaaggagattatgcaagtgctaccaatgaagattttgcaaaagatacggaagcagcgctgaactatctacgcagcagaaaagaaattaatacccggaaaatcggcattatcggacatagctgcggtggaacaatcgcatttgatattgccgccaaagaccccaacatctcatttatcatatcattggcaggagctgccgtgcgaggtgacagcttgatgcttaaacaagtggaattgatttccaagtcgcaagggatgcccgatccggtgtggcagacaatgaaaccatccgttcgccacagatactctttattacagcaaacggccaagtcgtcggatgaaatcagaaaagaggtgtacgctgatgttaccagaaccatgtctgccgaacagttgaaaaacctgaataccgtacaacaactatctgcccaaataaactccatgacctcgccgtggtatctccactttatgagatacgatccgactgcaagtctgaaaaaaataaagtgtccggtcctcgcattaaacggagaaaaagacattcaagtagatgccgatatgaatctgactgctatcaagcagcacatcagcgagaacggaaacaagaatgtaacaatcaaagcctatccaaaactgaaccacctgtttcagacttgtgagaaaggaactttagccgaatacggacaattggaagagacgataaatccggaagtcctgaaagacatgactgagtggataaaaaagcaataaattgatttaaatcaaaatcattcctgacgaactcattctgagagattttgttttacctttgcaccccgtaaaaatacgctaaataaagaaggtaaaaagtaacaggtatcaggttgagtttcgtatgaagaagagtcttattgcattggcattcggtaccctcggattgggtatcgccgagtttgtaatgatgggtatactgcccgatgtagccagagatttaaagattagcatccctgctgccggacatttcatttccgcctacgcactaggcgtttgtgtcggcgcccctgtattgacattagcacgtaaatatccactaaaacatatattgctggtattagtcacgctgattatggtaggtaatatctgtgcggcattatcacctaactactggatgctgcttatctcccgcttcatctccggacttcctcacggagcctatttcggggtcggttctatcgtcgcggaaaggctcgccgataaaggcaagagttcagaagctgtctccatcatgatagccggaatgaccatcgccaacctgttcggcgtaccgctgggaacttctttaagcaccatgctttcgtggcgggctaccttcctgctggtaggtctttggggaatcgtcattctgtattacatctggcgttgggttcctcaggtagaagggctgaaagataccggtttcaaaggacagttccgctttctcaaaactccggctccctggctcattctgggtgctacggcattaggtaatggcggcgtattctgctggtatagctatatcaatccaatgctcactcatatctccggtttctctgccgaaagtatcaccccgctgatgattcttgccggattcggtatggtcatgggaaatctgatcagcgggcggctctccgaccgctacactcccggaaaggtaggaactgccgcacaagcactgatctgcctgatgctattgcttatcttcttcctttctccctacaaatgggcggctgcgctattgatgtgcctctgcaccgcaggactgtttgccgtatccagtccggaacagatattgattatccgtgtagccaaaggaggcgaaatgctcggagctgcctgtgtacaggtagcgttcaatctgggaaatgccatcggagcttatgcaggaggactggcaatcagcggcggctaccgttatcccgccctgacgggtgttccgttcgcattgatcggcttcatccttttcctgatcttttataagaagtatcaagccaaatactaaactttgagtcaaagcaagccactggtaaataacttaatccaaagaaaaataaatcaccccaagtaataccgtaataccccaaacaaaacatacttttctgccgccaaacgcagattaatgggttttaattgcaaattaactctgtattaatcgccatcacactattttattaatgcctcccctataattttgcatctgacgtactttctcaataaacagatgaaaaacaatgaatgctttaaaaaaaagttggatgttatacttgtgcatactatgtggatggacaagtgtgtcggtagatgcaaaacaggacgataaaacagcgggaagatacactctttctctggatggtggagaatggcatttatggcaggacaagcaggcggaatggaaaaacgataaactgtttctgccggaagatgctacggatttgtcactccttcctgtgaatgttccgacaggaggctgggaacaactgaatccggccaatgccacagccgtgcaggtgccgggaaccgtggaggaatattgtacagtttccagtcgcccaagtccggacgatggagcaggagtcagctggtggtttagaactatcaaactcccggcaacactgaaaggcagacgggtgctgattcattttgaatcggtccgtatgcgtgccgagatttatctggacaggaagctggtgggatatgatatgattggagaatccccctttgacgtggatattacagaagcggtgaaacccggtgaagagcaacttctggcagtgcgggtgacacatccgggaggtaatttccattggcaggacttcacggagatgaattggggcagctatcagataccgcccggaaggtcattcggaggaatcatagggcgggtacgtctggatgcagtctctcctttgttcatatcagacatctatatgcagaaccaaccggaatataccaaagtgaaagcgattctgacagtgaacaataccctgatgaatacagaaaaggggcagctcatgttcacagttgcagaaaaggaaaacccatcgagaattatagctcgcagggatttgaagaacgttatcttgcaaaagggagaaaatacgataaccatggacctgaactgcccgaatgcgaaactctggaatctggattccccgcatctgtacgtttgccgggtcgaactcaaatcggctaaaagaatatgggatgcagattcccggactttcggtttccgctggtttgaaccgacagggattggaaaagatgcccagttgagactgaacgggcagcgggtgatgctgcttaccgccatcagttggggatattggcctgtgggcggcttgtatgccactccggaaatggccgaaaaacagatacttacagccaaggctttaggactgaatatgctgaatttccatcgttccatcggttcaccggtagtgctcgaaaaagcagatgaactgggactgctatatctggaagagccgggagcttttcactccgcaggacacgatcccttcatccggaccatagtcaataccaaactgcaacgaatgatcttgcgggacagaagtcatccaagtctcgtcatttataatctgataaatgaatggggaggtcctcgtgccagagataaagaactgactgccctgcgtatggaagacatgaaaaaggcgcatgccattgatccgagccgggtgatgacttttacttccggatgggcttctgccgaacattcggaagaggatgccaaggcaaatctgttacctttcgattcggtactgcaccggaagggatggttcgacaatcatcgcgccgcagggcctgccacttgggaggaagattactatagaggtccgaaagacaatctgatgtatacggacaaccggaccgaaatctatatacggggcgaagaaggtgctctttcaactcctccccgcattgccgaaattgccaaagaaatagaacagaccggaatcaaggggtgggacggattattctggaagaatcaatatgaggcatttcagcagtttttccatgagaagaacctggcaccttacttcggctccattgactcgctgacacgcgccatgggagatgtctctttcgaccatcaaggacggcgcattcaaggaatgcgtatgcagaatacaggagacgtttatgcagtgaacggctgggaagcgatgccgtatgacaaccattccggcattgtagacatctaccggaactgcaaaggaaatccttccacctttacttactatacccaaccgctctatgtagcggtctctccccgcacacagtttgtacacctgccgggaaaagtaccggtcgatttctacatcgttaatgaaaaaaatctttccggaaaataccgtttatcagtatttgtctgcacacccgacgggaaggaaggaaaacacatcgaaaaagaggtgcacattaccggaggagactgtttcggacagctattattggagcactgccagttggaaatagaaggagtttccggtttatatcaagtcaaggcgcaattacggaatgcgtcgggacacctgtgcgccgaagggaaagatgaagtacttggcatttactgggataagaagcaattgaaaggaaaaggtgctttatatggtactcccgatgatcctgttgctaccttttaccagaaagcaaccggatgcgagcttcctgctttccattcggatatagagaaactggactggattgtagtgacacgttcatccctggatgcgccgcagcctgttcctgttgaagcattttgtcagaaagaaggcaaatcggttttggaactctctctttataaagacgatgacttacgtacattggcgggggtgacccaagacaacaagatagaccgtactttcgcagacggtgcccaaccggaccccttgcttcctgccaaccaatctttttcagctatctgggatgggaaattaaaagcccctcagtccggcacctatatgattggggttacttccgatcagggaatgcgtctttccgtcaacggacagcgtattgttgatgaatggagaaataataaagaattgaccgtcgttcgccctttcttgttgaaagcaggtgatgaggtcgctgtccgtgtggaatacagtcaacgcaatcccacgggaagcgtacaattagtctggtctcttccggaccatgcggcgattgctccccaagagttattggatcgcgtaaaggaagacggtacttcattgctcttgttaaaatcggccgagtcatggatggatgctgtgagcgcatatacaggttcggcttatcatggctattattccgtaggaaagaactgggtaggcggcgttcatttcgtgaaagaacatcctcttttcaacggtcttccggtcaatgtagcaatgggatggccttatcaagccctggtgcgtaacggcgaccggcgtttagggctacatatagataatgaagaattagtggcaggctcatacggcagtgctccgtttaatcttggctctgctgtcggaatcatctcttgcggaaaagggaaaatctattattcaaccttagatttggttgataacctgaataatcctgcggctgcggctgatgtagcccgcaagttgttttgcaactttattcttttaagtaaggatagataatgcgaatcagtaatagctataaagcaatcgggtagttattgcaagaaaaaataattctgaaaggagagaatattttctctccttttgcttgaaaatcaacaagatatttttatatttgcgagaagtgtgagccttttgtacctaatcactttaaaaaacgacgaatatgacacaacagtatctgttcgaccgcttctcgcagcaagcgttgcaaaccctgcatcgctaccgtgctgttatgttcagtcccacctgccaccctatgtaaattgcatttgagattcttattttcttaatttccataatctacatagatcagattagtatggacaaacaatatcaaccgacccttaccgaagtacaggattgggtactcaaactgtacaatacctgtgaacaaaccatcacagaagccgaacgccgcgaacagcataaatacgctgtcatggtacaacgtccgcaggacaagaaattcctcgtgaagatgctggatgaatcttcgcaaatccgtgaccgaaggatacttgccaaacgtatcaaaacccttctcgaccaatacggcgttcccgaatttctgaacaagcgggacagcttcctgttcaaaatgtatcaggcattcggccatcatttcgactttatcgccatccccatcatcaagaagcgcctgcgcatgaacacctcgcaggtcatcatcaacgaagcgcgtccgcaactcacgaagcatctggccatccgtgcaaaggagaaaatcgggcagaacgtcaacctgctgggcgaagtggtgctcggcaacggagaagccgaccatcgttaccaccattatctgaaagcgctcgaatcacccgacatcaactacatatcagtgaaaatatcgggaatctatgcgcagacacacgccttgaattatgaagaaagttttccggaactcatttcgcgaatgtccgcgctttatcagaaagcgattgatttcccctatacggacgaagaaggagtcagacgatccaagtttatcaatctggatatggaggagtacaaagatacccatttcacattacgcctcttcaagacagtgctcagcctgccgcagttcaagaactattccgccggaatcgtcgttcaggcatatctgccggacgcatacgactttcagaccgaactgatcgaatttgccaaagcacgtgtggcagaaggcggtgctccgatcaagatgcgtctggtgaaaggctgcaacctggaaatggaaaccgtcatctcttcgctgagaggctggcccaatccgatccgcccttccaaagaagaagtagacgccaactacctgcatctgctggaacgggcactgatgcccgaaaacgcaagggtattgcatcttggagtagcttcccataacctgttctccatcgcctacgcctatctgctggctcagaaatatggtacagccgaatacatgaccttcgaaatgctggaagggatggcgaaccacctatggagagcccaatccatgctcggcaaccgggtgattctttatactcccgtagtgaaaaacgaacattttctgaatgccgtctcatatctcgtccgccggatggatgagaatacggcacctgataacttcctgactcactctttcaatctgagaccgaacacaaaagagtgggatttcctggctaagcagttcgaagatgcctacgccatgaaagatcaactgagtcatgtgtccccacgcacacagaatcgcaatcttccttacacgcccgtcccaccggcagacgtcctgaagaatgaaccggacacggacttcgacctgccacagaatcaggaatgggtgcgttctatcttctccaaatggaagaaagacggaacggaacagccggaaatcattccgctgcaaataggtgcggaaacggtggtatgcgaaagccgctacccatatacagaccgttgtcaggacgatgaagtctgtatctgtgaaatgtcgcaggcggacagcgcacaagtggagaaaatcatcgaaattgcagaggcagaccctgccggatggagaaagaccacactcgaagaacgccaccggatcatgtacgaagcagccaaccggctcgccgatatgcggggcgatctgataggctgtatgtgtgccgtgacgggtaaaaccgtcattgaaggtgatgtagaagtatcggaagcggtagactatgcccgtttctatacgacagcgatgaagaagtttgccgcgctggatgacgtagaaatgaaaccgaaaggcaccatactggtcatctccccgtggaacttcccctgtgccatccctgtgggcggcatagtagccggactggcgggaggaaataccgttatactgaaacctgccaccgtagccgcccctgttgcgtggatgtttgccaaggcattctgggatgccggtgtgccgaaggaagcgctgcaagtcatcatcacccgccgggaagcactgaaagtactgactaccgcccccgccatcaaacatatcattctgacaggaggaacggacaccgcacagaatatcgcaaaagccaatccgaccactccgttatcggcagaaacgggaggtaaaaacgttattatcctcacagcgtcgggcgaccgtgaccacgccatcatgaacatcgtcacttctgccttcggcaatgccggacagaagtgttccgcctgttcgctgttgttagtcgaacgttccgtatacgaagacgaaaacttccgtagcaagctgaaagatgcggcgacaagcctgaaaaccggcagtgtgtggaatgccggaaatatcgtcggtccgatgattaccaacaagaacgataagttactgcaagccttcaacctcgaaccgggtgagtcatggctggttcccccgcgtttcatcgaccgcagagagtacatccttgcaccaactgtcaaatggggagtaaaaccggaaagtttctcattccgcaccgaattgttcggtcccctgctgagcgtggcctgtatcgagaaccttgaagaaggaatcaggctggtgaacgggttggattacggattgacctccggcctgcaaagtctggatgaaaaggagcagaagctgtggaagaactccgtaatggcaggaaacctgtatatcaaccggggaattaccggagccatcgtcaaccggcaaccattcggaggaatgaaactatccgccttcggtggtggtatcaaagcaggtggccccaactactgtacctgtttcctcgaaatcaccgacaaaccggacagccggaccgactaccgacagagttatgccaaagcctatcaggaagagttctcaaaaccgagagacgtcaaccggctatatggagaacaaaacctcttccgctatctgcctttgaagaacatgattctacgcctcttcccgaaagatacagacgaagaagcgacgatgattgcacacgccgcccgtatatgcagaactccgctcaccatcagttttggcccgacagatgatcgtagcagcagacttgccggactcggctgcacactccggaaagaatcattagaggacttcctgaaagaattgcccgaatatgaaagagtacgtacctgttcgccggatatacccgatgtcatgtacgaacgggcagcggaaaccaataaatacattgcgacagcaccgcctgtgaagcaagggcgcatcgagctgatacactatatcaaggagcaaagcatcgcctttgagtatcaccggtatggcagtatttcggaagtaccgccttgcgaataacgaatactgaaatcccccttattcttaattactctcaaatagaaagtaaagccagagaataaggggattttttaagaactcactaaagatgaaattatcatagtgacagaataaaatcaattcaaagtattaatggcaccatattgccgtttctgctgacagatacattttgaaaagaacgccagtcagctctcagagaaagaataggatgtatcaatatgcagactatttgcatatcatttccgttttattggaagattatgcaaaggagtcgttacttgacacgcagaatatatatatccaacctacagaacattaatagctgatatgtcagctaaccttatccaacgtgttggtcatatatatccaacgtgtcagtcaaccttatccaaagcatcaagccttcatatttgacaagaagggcatggttgcccaattattagccttgtaaagattcagataccgccctatttatgaacaaaatacagattttcattcgcatattttcccccactcccgccgtcgggcaggaaaacggcattctgaagagactaaaaattcattttgtcaatttgctcaaaacctttttccagccagcacaattatcagaaaaagacagaaagtgcaccaagtttccctcattagctcaaaaaatgattatctttgcaaactaaaatgagcaggctggcaatcaaaactgtttttatcgggagattagcgccaagtcgctgctcacatgatatgattcattgataataaaagaaataatagattaatatggcattgcaatgtggtattgtcggacttccgaacgtaggtaaatcgacacttttcaactgtttgtcaaacgcaaaagcgcaagcggcaaacttccccttctgtacaatcgaaccgaatgtaggcgtaatcaccgttcccgacgaacgcctgaacgcactggcagaactggtacatccccaacggattgtccccacgactgtagaaatcgtagacatcgccggactggtgaaaggtgcaagcaaaggcgaaggactgggaaacaaattccttgccaatatccgcgaaacagacgcaatcatccatgtactccgctgcttcgacgatgataacgtgacccacgtagacggaagcgtaaaccccgtccgtgacaaagaaatcatcgactacgaacttcagctgaaagacctggaaaccatcgaaagccgtatccagaaagtacagaaacaggctcagaccggtggcgacaaggctgcaaagcaggcttatgacgtactcattcaatacaaggatgcactggaacaaggcaaatccgcccgcaccgtcactttcgaaacgaaagacgaacaaaagatcgctcacgaactcttcctgttgaccagcaaacccgtgatgtacgtctgcaacgtagacgaagcaagtgcggtaaacggcaacaaatacgtagacatggtgcgtgaagccgtgaaagacgaaaacgcagaaatcctcgttgtcgccgcaaaaaccgaagcagacatcgccgaactggaaacatacgaagaccgtcagatgttccttgccgaagtagggctggaagaatcgggcgtcgcacgtcttatcaagtcagcttacaagctgctgaacctcgaaacttacttcacagccggtgtacaggaagtacgtgcatggacttacgagaaaggatggaaagctccgcaatgcgcaggcgtcatccataccgatttcgagaaaggatttatccgcgcggaagtaatcaaatacgatgattatatccagtacggctccgaagcggctgtcaaggaagccggaaaactcggtgtggaaggaaaagaatatgtggtgcaggacggcgacatcatgcacttccgattcaacgtttaaactcaaacagtatgaaatatcttattgcaggaaccggaggcgtcggtggcagtatcgcaggattcttgtcgctagccggaaaagatgttacttgtattgcccgcggagctcatctgcaggctatacagaaagacggtctgaaactgaaatcagatttaaagggagagcatacgctggttatccctaccatgaatgcggaggaatttaacgggaaagcggatgtgatcttcgtctgcgtgaaaggatattccgtcgattcgattaccgaactcatcaaaagagcatcgcatgagaagacagtcgtcatccctatcctgaatgtttacgggacaggaccacgcattcagcgtctcgttccgggtgtaacggtgctcgatggttgcatctacatcgtaggctttgtttccggcacgggagagatcactcagatggggaaaatcttccgtctggtgtatggcgcccacaaagggacacaggtggctccgggcattatggaagccattcagaaagaccttcaggaaagtggaatcaaagcagagatttctccggacatcaatcgggatacattcgtcaaatggtcgttcatctcggcaatggccgtcaccggtgcttactatgacgtgccgatgggtgaagttcagaagccggggaaagtacgtgatacgttcatcggcctttctaccgagagtgccgcactggggcgtaagctgggagtcgaatttcccgaagaccctgtcagctacaatttgaaagtcattgataaactcgatcccgacagtaccgcatccatgcaaaaggacttggcacggggacatgaatcggaaatacaaggtttgctgtttgacatgattgcagcagccgaggagcaaggtatcgacataccaacttaccggatggttgccgaaaaattcacaaaacactaattacaaaccgtaaaccgttatccaacatgaatacccttttattatcaatcaactggaatccgaatcccgaactattcaacctgttcggcatttctatccgttattatggattattgtgggcagtaggaatcttctttgcttacatcattgtccattaccagtttcgcgacaaaaaaatagacgagaagaaattcgatcccctcttcttttattgtttcttcggtattctgattggagcacgtctggggcactgcctgttctacgatccgggacagtacctgaccagcggaaagggatttgtggaaatgcttctgccgatcaagttcctggcaggcggcggatggaaattcaccggttatgaaggacttgccagtcacggaggtacgctcggattgatgatcgccctttggctgtattgtcgcaagacgaaacttcattatatggatgtggtggacatgattgccgtcgctactccgatcactgcctgtttcatccgtctggcgaatctgatgaactccgaaattatcggtaacccgaccaatgtaccctgggcgttcgtattcgaacgggtagacatgctcccccgccatccgggacagctctatgaagcgatagcttatctgatcctgttcttcatcatgatctatctttataagaattacagcaagaaactgcatcgcggattcttcttcggactctgtctggcttatatctttaccttccgtttctttatcgaatttgtgaagcagaaccaggaagcattcgaagacaacatgatgttcaacatgggacaatggctgagcgttcctttcatcatcatcggtttctactttatgttcttctatgaccggaagaaggtagcaaagaaatgaaacaaatcatagatatagaaaactgggagcggaaggagaatttcaacttcttccgccacttccagaatccccaattatccattacctccgaagtagagtgcggaggagccaggcaacgtgccaaagccgccggacagtctttctttctccattatctttatgctgtgctgcgtgcagccaacgaaataccggagtttcgttaccgcatcgatccggacggacgtgtagtgctctatgacaccatagatatgttgtctcccatcaagataaaagagaacggcaagttcttcaccacccgtttcccctaccacaacgatttcgacactttctatcaggaagcaaggctaattatcgacgccatccccgaagacggcgatccgtatgcggcagaaaacgaagaagtagccgacggagattacggactgattctgttaagtgcgactcccgacctgtactttacttccatcaccggcacacaagagaagagaagcggcaataactatccgttgctgaatgccggaaaagccatcataagggaaggcagactggtgatgcctatcgcgatgacgattcatcacggatttattgacgggcatcatctttccttgttttataaaaaggtggaagactttctgaaataatagtgctgttcaaatagtattttctcattccttttatctacctttagcgcgactaaatgataaaaatatgagcacaaaaacactattcaaactactatgggtgcctttcgtcacatccgtattcgcaagttgcagtgacaaagaagaattactttacactcctccggaagaaacgaatgacagttacataagccctgccgtaccacaaggtaatagctggcctgaagcctccatgtcacttacacagccttttctgggtgccggatatgatattatgggcagctacatagacaataattcggtaaaagaaccagtgcttgatctgagcaaaatagataatgaaaggattagcaatctggtaggttcgagcggagtaggagacagcttcattggtcgtgatatgaaagagtttcttcggtcaatcacaaaatataagaaatttgtggtgccggcggaaaacaaagatgatttgctgtttaccgctaccattaccggtcataaatattttcagaaaccttatgattattcatcccaatacacatttgcctttggcagttcaggagctaacggagtgattcaaagattactcactctgaatgcggattggtccaactggctggccgatgatttccggcaagagctggaagatgcgtcacctgaaacaatcatagaactatttggtactcatatattggtgaacactcatttaggttatataagcaaaaccctctatcgcagcatcgtagcggatgatgaagagaacttattgagaaccgcaaatacagggatgggcgcacatcagagcagcattattaagcatcccaatgtttccatcacttatcccgaagaaacagtaaaaaagaactatgggggaacaattgtagtgtcattgcaaggagctgattacaaagtctttgatcagctgacaggcgatccgatggatatcagcccctggatacaatctgccaatgaaaagaatcgcgccttaactactctgaccggtgaagaccttatccccatctatgaggtaatagccgaccccataaagaaacagcaaataaaagaagcggtaatagcccatatcaaaaggcaccaactgtccttacaacaaacggctcccatctttcaggcaagtgacgggcactatcaccgctactatacctcttataaggagttaaccgcaaaggccgatatctgtcaaggtgtgataggaagcgtatttgtcagacacgaaccgggtacagtaccgctttacctgtcttccgacggaaagaatcaccgtttgacattagaaccggcaccgaacggagacggaacaatcatagggtatgtctatgaaaagaagagcgatgacttaaactgtatctacgaaatatcagacggaaaaaactttgcctataccacggaagaaaaggatacctacggaaacaaaggcacatggaagccaaccggcctctctttctatacaaagaaggtataagcataaggccataccattggcacggcaagtaaccctataacttacaacataagaagtctatagtatcttcgttggggctgactaaaagtcgttagtatctccattctcctccttccggaaggaggagagtttaaagttactaacgactttttagtcagcccccgcataagttatatcagtttttatttgcctctgactatcttctttatatcgttcagcttattcaacgcctcaatcggagtaaggttattcacatccagattcagtatctcatcccgaatctggcaaaggatcgggtcgtccaactggaagaagctgagctgcataccgcttctgttttcactgacttccgtcaatggtttgccggaaataccttgctggcggttgtccgattccagttgcttcaatatagtatttgcacgcttcacaatactcttcggcatacctgccatctttgctacatgaataccgaaggagtgttcgcttcccccacgctccagcttacggaggaaaatcactttattgtccacttccttcacagacacgttatagttcttgatgcgtttgaaggatttctccatctcgttcagctcatggtaatgcgtagcaaacagtgtacgggctttcgctttcggatgttcgtggatatactcgacgattgcccaggcaatggaaataccgtcataggtagacgtaccacgtcccaactcatcaaataacaccagacttctggaagagacattattcagaatatccgcagcctcattcatttccaccataaaagtagattcgcccaccgagatattatcgctggcacctacacgggtgaaaatcttatccaccagaccgatatgggcactctccgcaggaacaaacgaaccgatttgcgccaacagcgtaatcagtgccgtctgacgcaagagcgcggacttaccggccatattgggaccggtgatgatgataatctgctgtgacgcgctgtccagcatcacgtcattggcaatatacttctcaccaatcggaagctgcttttcaatcacagggtgacgtccctgacggatatccagtacatcattgtcctcaataaccggacggatataattattctcacgcgccacattagcgaaagacaacagacagtccagacgagcaatctgattcgcattaatctgtatctgcggaataaactccgtcaatgcctgcaccaaatcggtatataactgagtctccagcacgagaatcttatcttcggctcccagaatcttttcttcgtaaaccttcagttcctgcgtaatataacgttccgcattgaccagtgtctgcttgcgaatccattcctgcggaactttatccttatgtatattgcggacttcaatataataaccgaatacattattgtaagctaccttcagactcggaatgcctgtctgctcactttcacgctgctgtatctgcaacagatagtctttgccggagtatgaaatacggcgtaattcgtccagttcctcattcacaccatctttaatcacgccccctttgttgatcaataaaggagggtcattattgatttctttggcaatccggtcgcgaatagaaatacaaagattcagctgttcacctatccggttcaaacttgcgttatccgcttcaagacaagcctgcttgatcggttcaatggcctgcaaggcaaccttcaactgtaccacctcacgtggcgacacacgtcctacggctactttggaaatgatacgttccaagtctcctatcagatgcaactgctcctcgatcagctctttaaaatccggctggcggaagaagtattccaccacattcagtcggtcgttgatcggcttctcatccttcaacgggaaaaccatccagcgtttcagcaggcgggctcccatcggactgatggtacggtcgatcacgttcagcaaactgctgccgccgtcattcatgctgccgatcagctccaggctgcgaactgtaaacttatccagacgcacatacttatcctcctcgatacgggcaagggaagtaatgtgaccgatctgcgtatgctgtgtcatcgtcaggtattgcaggatagcaccggaagcaatgataccattcttcaggtgctccaccccgaatcctttcagattctttgtctcaaagtgtttcagtagtttctcacgggcagtggattcggtaaatacccagtcgtccagttcgaatgtgaagaacttgctgccgaagttaccttcaaacatcaggcgtttgccccgttcgaaaagaatctctttcggtccgaagttattcagcaatttgtctacatagtcaaagggaccttcggcggtgaggaactcaccggtagatatatcaagaaaggcaactccacaggaagcctttccgaaatggacggcagccaggaagttattctccttataattcagaacgttatcattgatagatacaccgggggtaaccaactcggtaatacctcttttcaccagtttcttcgtcagtttcgggtcttccagctggtcacagatagctacacgctttccggcacgaatcagtttcggaagatatgtatcaagcgcatgatggggaaatcctgccatctcgatagtctttccttttccattggcgcgttttgtcagtgtgattcctaagatttcggatgcaacaatggcatcggtagaatatgtttcataaaagtcaccgcaacgaaacagcatcactgcatccggatgtttggctttcaaatccagaaactgtttcatcatgggggtaagcacgatttcttcctcgttcacggttcgctccttttcttttttgttgagtgaataatgagattaaccttgcaaagataacagttttccggcagagaatcaacggaatttcccgtttcaattttcacaattagtgttgcatccttttaaaaaagaagggtatatttcttaacaagtaaaggaaaactattaaaacgtgttataaaacatactattttacttggataatttgctaatttcccaatagtccgtatctttgcaatgtgtttttcatagtattagatttaaggttaacaaaggttgggtcaaggcgttgaccctttttttatgtccatacgtcccgtttgcctctttctttcattcatttctattcagccagcatcatccttttatagtaagacggagtgaatccggtatgcttcttgaacgacttattaaaatgagaaatcgtatcaaatccgcactccacactgatctgcgaaatattcatatcgcccatgagcaagagtttacacgcatatcctatccgcatctccaatatgtaattcttgaatgatttccccgttttgctcttgaagaagcggcagaatgcagcaggattcatagctgccagagaagatatttcattcaggtcaatctgccgtgtatagttcttattcaggtaaactatgattttgtctattctcgatccgtcgtagataatatcattttcaaaatcggaagtcgatagcacagaccgtgaagcgacgtttgccatttctttcagaagttgcaggaaagaagtaatctgatcgactcctgtctccaccggaatcgattcaagcaaatcaaccagccgcggggagcatcctgcgggaaagtaaatcccccgttgcgcctcttcaagcaggttctttatcttcataaaatggggataataattgaaagcgtggtgcatgaagtccttttcaaactgaatgatggtccctgttgtccgaagcgtactgccttcttgccgatacacctcatcgctcttcatataatgaggcaaatcggagcctagcagaagaatatcaccatcagcgtatttctccgcgttatttcctacaaaacgcattcctgtgccctccttgacatagataatctcatactccgtatgaaaatgccacgggtaagtaaaataaggataatcataaaaacgagctttcagaggagatgacttcgatataggaagctgctcattcatcatttttctcataatctactctatttcttatctactctatttcttttcagcccaatataccccgcagacaatacaagctgcgccgcctaaagcgactaacgtaatcttctcatccagaataaggaacgatgcaatcatcgtgaccagaggattgagataaatataattggatgcccgtaccgttcccaactgttttaacaccacattccagagtacatagcagatcagcgaagccaatacggccagaaacagaaggttgaacagaacggcaggttgaagaagtacagcggtatcgggatgcaggggatgcaggaggaaggcaggcagaatcgtcagtactccgtaaaagaaaatcttgcgggtgataaatatggtaggataacgcccggccatctttttaataatcagactatagaatgcccatgataatgcggcaagcaaagtcagcagatcgcctatcggagatattttgagcacaaaactgccgttaaagacaattagccctacccccatcaatgccagcagggaaccgtatatcagtcctttcgatgccttttcacttttatagaaaagcagggaaaggatagtagtcagcaagggagccgtgcagatgataaacgatacattcgacgcctgggtgatgcctaaagcggtattctctgtaaagaaataaagggagccaccgaatataccgcctgctaccagccacagttcatcttgccagttattggtgaacagacgtttgggagaaattacccagatgccaaggtatgcaatcagaaaacggtaaaagaagatttcctgaggtgtcagcccgtggtttatcaatactttagtcgaaatgaatgtcagtccccagatagctactgttagtatggcaatcagatgatagtacccatgctttagttccataattatggttttaatgagaatgcaaagatacagggattcatggatatacccactgactttgatagatatattttcaacaaaatttcgccgaaagagaaccggttatacatccggatataacaagaaagcgaatatccggatgtctgataaaatagctgtatctattcaggtaatcgtctgcttttaccagttatccgtccggaagggtgccgcggggatgccatgaatactgaaaatacttgcttccacataattcttatacgcataccgcacggcaacgggatgagagactttgtcactcgaaaccgccagtcgggcagtcgtggtttctatttcggcaaaagccggatagaatactttatcctcgcccgcaatctcaaatcctttaagagatgtccacatcggacttaggccgcgttgggcattgtagaagtttatatagattttattctcctgtatctccatcgatttataaacagggggagcgtatccgaatcctttcatgccgtaggtctgcgccaatgcccaatacgccagtcggttccctaccgtctccttgtctacgggatggatgaaaacagggtggccgacatccatcgtcgtaaccatgccgctatttggtatatccttcatattctgcaactggacctcacgcaggcgggcagccgatgtaccgtcggctccttcgtaatcgaaaggcgctatctgcacaaagtagaaaggaagttcgcccctgccccatttcgcacgcaagtcagccacaaaggcaggcataaggctctggtaaagatcggcattgtcacggttgctttcgccctgataccacaagaagcctctcactgcaaaattagtcaaaggagctatcttgccattgtagagtacacacggagtggcggtaggattcttcacttcagcatcgttatcgaggatggaaagatcaatgctactaaaaggctttatggattctctgctcatccatgcctctatttttgatcctccccacgtagaaacgacgatgccgaccggaacttccagcacttcctgtatataacgcgcaaaataataagacacggcgctgatatgggaaacgtttaccggcgtattttccagccattcgccctggcagtcctccacaggcgttttactaaactggcgtacccatctcccatcctttgaatctgtagtatacattcggataggcgtggatggtttggctttggcaataatgtcgttcgtccctctgaccggttgccggtcgaaaccgcccatcggcatctccatattcgattgtcccgaacagaaccagacttcaccgatcagtacattctgcaacgtcagtaattcgccgtcattgaagatgatcttgtaagggcctcccgcaacaggggtagatactgttaacgaccagcctcccttgccatccgatgaggatttatatgtctgcccgttccacgaagtcttcaccgttacagtagcattgggacgggcttttccccatagtttgacttctgcttgctgctgtaataccatattatctccgagtatggaaggtaatgtcactttagcctcacttttcattgaaaaagcaagagctaagaataaaaagctgataagatatttcatatatattcaatttatttattcggttagttacaacaggattgaccaatcttcggaatatatcctaccggaagaggtagtcggaatgagataagctttagcttgttattccaatagaattcgaacgatagaaatcgccaagaagttcaagctgataaggactaaaggtcatgtcactctttttcatcttttattcattttagttgatacttatagtagtcaaccaaatccagggtaagacaaactacttcttggagaataatcttgtaggagagatgggaaaaggaaagccttggtgacttcgaggcaaataaagaagatcggcttgcactgcgacgattgtcgtgtagcaagccgacctttatttcattttatctatgtatcttatacgttctttaccttgatcagatactcagcgatctgtacagcattcagtgcagcaccttttttgatctgatcgccaacgatccagaatgtcagaccgttttcatttgtaaggtctttgcggatacgtccaacgtacacagggtctttgcctgcaaggaacaacggcatcgggtattccttttcagcaggattgtcctgaagaacgagaccctcgcctttggcgaatgcttcacgggcttcttctaccgagatcggacgttctgtttccacccagatgctttcagagtgagcacgaagtgcgggaacacgtacgcaggttgcactgactttcacgtcagagtgcataatcttgcgtgtttcgttatacatcttcatttcttctttggtataaccgttttccgtgaacacgtcgatctgcggaatcaggttgaatgccagctgataagcaaacttctctactgtcacaggctcgttggccaatacctgacggtattgttcgtacaactcgtccatagcggcagcaccggcaccgctggcagcctgataagtagatacgtgcacggtttttatatgagaaagctgttcgatggctttcagtgcaactaccatctggatagttgtacagttaggattggcaatgacgccacgcggacgctccaacgcatctgcggcatttacttcgggcactaccaaaggcacatcagcgtccatacggaaagcgctggagttgtcgatcatcacagcaccgtatttggtgattgttttctcgaactccttggatgttcctgcaccggcagaagtgaaagcaatgtctactcctttaaagtcatcgttgtgttgtaagagtttgacctcgatctgtttaccgcggaaagtataggttgttccggcactgcgtttagaaccgaacaaaactaactcgtccatcgggaaatttctctcatcgagcacgcgcaggaattcctgtcctacggctccgcttacgccaacaatagctactttcatctttttcttttgttaaatgtgaataatgtggttaatcgctgcaaaattagaacattttatcatataatcagcattttggagatacttcttcacattttatcagttcccatcctttaaattggagcaaaatgcaatgcaatgcagtcccttcactgatagttgttacctttttatcccggctatattgttttagttgccctctgccttcttccgcttgttcttccagttccttatcggtggcggtgcgcgggaggtattttaattccagaatataactgtgtgccgtgtccgggtagcgggatttgtccggcaggaggaaaaagtcacaatatccgtaattcatctccaattccggctgaaccagataataagaagcaagagcaaggtatgctttgaagaaaccttgcaaattgtgttctccctcgatggcatcgcggatggcggagttttctttataggcaagggctatgtactcaaacagagggcgccattgtccgtcgaaggccatgtcgtcaattaaatcttttaagtgaggcaagaatacttccttacgctgctggtagtattcccgaaggaatccgaaatactgctcacggacgcaattgttaggaatgcacatcacaatacggtctccacgtgtgccacacattgtaagcagtccataataataaagcaggctgcggaaattgtctgtttcaacaatcttctctgccgggaaggaggtgtggaggtttaccagtatctctcctttagcagctatctcttcaatcgtactcatgcggtcttcccccgacacattctcatggtcgaggcgtgccaacattttcagcttgctgtagtccgtacggatattcttgtcgatcaattccttaggggaggcgtcgaaattaacccggtgacgcaaataatatagcgtcatgtcgcaattgaacattctcggatcggtcttcaaactggcttctgcaaagcagtaattgtcataccacggtttcatttcattaatcatggcatctatatctcctttcagcataccttctttctgataatagccgaacatctcccgtacatccgtttcgctgaatcccatcatcatattgaaatgtgggtccacactgatattccagtctatgttatatccgctggataagtcgtccagcgtaacaggacttacccccatcaggaagatgcgttcgaacatacccttgaactgcttgaagtattctcggtagaagccgctggcgtgggtcaggtcgcggaaaaggtttttcccctgttcactcaggatgacattcgtaaagttgtcatattcatcaatgatgaggtagagcaaatgtcccaggcggcgggcggtggcttccagccaatgcagctttgtagcggcttcggtagaagcgatgatttgctccagttctttctcgccttggtagtattcccggtaagtactgaagaagtcgttcaactgtatgcagcaataattgttgaagttgtcttccagacttccacgtcccaggtttgctttggaaaagtcaaaatagagcacctggtagattccctgaagcggggtggggtgcttaccgatccatagattgccgaaccgttcttcaaaacgatctttctgtgaaatatcgtaataggcacgcatcatggtgagaaatacactcttgccgaaccgtcggggacgaataaggaaaaggtagtttgctatttcttctatctggggaatgaaatgcgttttatctacataataataattttggtctatcagcctgctgaagtccgatatgccgtatgggattccttttgccataatgcgttcattttattgggatggatgcaaagttaagttttctttttatctccaacaactatccttctgcaattgttgctattattcctattaaataaacaggaggatgagatttataatacctgcattgtgattctgcgaacttttttgttcctttgcgtagaaatcctaaaaccacggacctatgaacctgtttgaattcaatttagcgttaccgataaccgatccgacttgggtgttttttctggtgctaattatcattctctttgctccgatgattctggggcgccttcatatacctcatattatcggtatgattctggccggtgtgctgatcggcgaacacggattccatgtgctcgaccgtgacagcagcttcgaactgtttggtaaagtggggctttactatatcatgttccttgccggactcgaaatggacatggaggacttcaagaaaaaccggatgaagagcgttgtcttcggcttgcttactttcctgattcctatggcgctgggtatatggagcagtatgagcatgctgggatacggttttcttaccgcagtgctgctcgccagtatgtacgcttctcacactttgattgcttatcctattatcagccgttacggattatcccgtctgcgcagtgtcaatattactatcggtggtacggccattacggtcactcttgcccttatcatccttgccgttattggcggaatgtttaaaggcaccgtcgatggtctgttctgggtgttcctcgttgcgaaagtagccttccttggtttccttattatcttcttcttcccccgcatcggacgctggttcttccggaagtatgacgatagcgtgatgcagttcgtgttcgtgctggcgatggtcttcctcggaggcggactgatggagtttgtaggaatggaaggaattttgggagctttccttgccggattggtcctgaaccgcttgattcctcatgtctctccgctgatgaaccgtctggaatttgtgggaaatgccttgttcattccttactttctgatcggtgtcggtatgattatcgatgtcagaagcctgtttacggggggcgaagcattgaaagtggcggtagtcatgacagtggtagctactttcagtaaatggcttgccgcatggatcacgcagaagatttaccgtatgcagcccaatgaacgcagcatgatcttcggactcagtaatgcacaggcggcggctacgctggcagcggtgctgatcgggcacgaaattatcatggaaaacggagagcgtctgctcaatgatgacgtactgaacggtacggtcgtgatgatccttttcacctgtgtcatcagttcgctggtaacggaacgttccgcccgccggtttgcactgaacgaagatgcgcagcccgaagataagggagcgaagaaagcgatggagcagattctgattccggtagctaatccggaaacgattgagaacctggtgaatctcgccctggtgatcaaggatgccaagcagaagaatggcatgattgccctgaatgtgattaatgacaataacagctcggagaataaggaactgcaaggcaagcggaatctcgaaaaagccgcaatgattgccgctgccgccgatgtaccggtgacgatggtaagccgctacgatctgaacattgcttcggggattatacatacgattaaggaatatgaggctacggatgtagtgatcggtctgcaccgcaaggcgaatatcgtcgattccttctttggcaaccttgccgaaagcctgctgaaaggtactcaccgcgaagtgatgatagccaaattcctgatgccggtcaatacgctccgccgcatcatcatcgccgttccgcccaaagccgaatttgaaaccggtttttccaaatgggtagagcatttctgccggatgggaagcattctcggctgccgtgtgcacttctttgccaacgaacgtacactgatgcgtctgcaacaactggtgaagaagaaattcagcggtaccccgaccgaattttctctgctcgaagagtggggcgaccttctgctgctgaccggacaggtgaactacgatcatttattcgttgtcatctctgcccgtcggggttctatctcgtatgatccgtcctttgaacgtctgccggcacagctgagcaagtatttctccaacaacagtctgattatcctgtaccccgaccagttcggcgatccgcaggagattgtgtctttctccgacccgcgtggttacaacgaatcgcagcattatgaaaaggtgggcaaatggttttataaatggtttaagaaaagctgatggaagaaaataactggcaacaacggacagaactcctgttgggagaagagaaaatgaagcgcatccgtgcttcgcatgtattggttgtcgggctgggaggcgtgggggcgtatgctgccgaaatgctttgccgggctggggtaggcaggatgacgattgtagacgcggataccgtgcagcctgccaatatgaaccgtcagcttcctgccatgcactccaccctggggatgccgaaagcggaagtgttggcggcacgctacaaagacatcaatccggatattgaactgaccgttttacccgtctatctgaaagacgagaacatccccgaactgttggactctgctaagtttgacttcatagtggatgccatcgatacgatcagccccaaatgctttctgatttatgaagcgatgaagcgtcatataaagattgtttccagcatgggcgcaggcgcgaagagcgatattacgcagatttgctttgccgatctttgggatacctatcactgcggactcagcaaagcggtgcggaagcgtttgcagaaaatgggagtaaagcgtaaacttcccgtcgtattcagtaccgaacaggcggacccgaaagcggtattgctcacggatgacgaacggaataagaaatcgacctgcggaacggtcagctatatgccggcagtcttcggctgctatctggcggaatatgtcattaaacgaatctaagaagctattatgataaaattagaaggaataaccaagagttttggttctttgcaggtgctgaaaggcattgatctggaaatcaataaaggtgagatcgtcagtatcgtaggacctagcggagccggaaaaacgactctcttacagatcatgggaacgcttgacgaaccggatgcgggcacggtggcgattgacggaacggtagtcagccggatgaaggagaaagaactgtccgctttccgcaataagaatatcggttttgtgtttcagtttcatcagcttctgccggagtttaccgcgttggagaatgtgatgatccccgcatttatcgccggagtatcgtctaaggaagcaaacgaacgtgctatggagatactggctttcatgggactcaccgaccgtgcttcccataagccgaacgaactgtcgggaggagagaagcaacgggtggccgtagcacgtgccttgattaaccatccggcagtcatccttgcggacgaaccttccggaagtctcgatacacataataaagaagatttacaccaattgttcttcgacctgagggaccggttgggacagactttcgtcatcgttacccatgatgaaggactggccaaaatcaccgatagaacggtacatatggtggatggcacaattaaaaaagattaataaggaaaccaaacttctaaaaatggataccaaatcactagaagattgtgtgagttcaatcttttagctatatatttatagtcgcttctctacgtaagtctgtgaagatgtcagtagagtgtttgttttgtttgtgtgtgatgcattcttgtctggtgtgataggaatgcatctttttttatatatcacaacaaatacgattttagtcgtaacaaacataaggcgccattcgttcgaaatctgcgggtgtgaattcctcgtaaagcatcagttgtttcaagtctcttactttccccttcttcttccggtactctgcaatgaccttggcttgataatagctgatgtacggatgatgcatcattcgctctacacttgccttattgatgttgatccggtgaatctttccagcatccacggagaaccacgaacggagcttttccgcttttaaccgaatctcccctaactgttctatctgatagaatcctcccaataaccggcgatggtttacaatcgatcgggcaatccggcttccgatccccggaatctttttaagttcggtggtatccgcctgattaaggtcgatgatagtgcccggcgggtatttcattaaagtatcatatggtgcagtcgcttgtactactaatatccggctggtatcttgaaggaccggtgtttcggcaatgcgtatatacggttgaagagtccggtattgttcttccgtcagcccgtatattttccgaaagtcttccggacgtcggaatctgccttgctttctgcggtatcgcagaatattgcccgccatccaggtaggcaagccgagactgaggaaagtggcggagtcggcggtattcggatcgaacgctgccggtctgatttcttttttcggataggcgggcgatgaatacctgcctctgtaaactggatatttcttgtcctgctttgcttcttttatggaagagataaattcattatattccttttcggatttcgcctgttcagtcgggtcggttttctccggtccggagaaagcctgcaagagtgcggggattgtgtatacccctataacaagaacgacaaggacgataatgccttgtcgttcggttttagtaaaataaaaaaagtctttccacattatagtttgataagtcccaactcattgataaagatcagagagatggcaatcggtgcaatatatcttaatataaagatgatcagtttgtatacgggaactttcagcgaaccgtcattggtgatctccgaccagacgattttcttgtcgagataccatccggtaaagatggaaatgcacagaccgccgagtgtcagcatgatcttagccgtgacaaagtcgaataagtcaaagattcccaatccgaagatggtgaatcctttcatcactccgagcgacaaagaacaaaggatacctaagaagatacatcctccggtcaccagtctggctgccttgccgcgtgtgaagttgaattcttcgtgcagataagcggtgaccacttcgtgcagggaaatggtggaagtcagtgctgccatggcaagcaatacgtagaacatgacggagaagatataggccaatatcggtactccgctgaatgcctgctggaatacattgggcagtgtgataaagataaggctcggacccgcatccggttgtatgcctacagaaaatgcggccggaaagataatgaagcctgccaatactgccacaaatgtatctataatccctacgctgaatgctgtcttggtcagattggtttctttgctgaaataagaagcgtaggtgcagagacatcccatccccaggctaagggagaagaaagcctgtcccatcgcactcagaaatacatttccgtccaccttgctgaaatccggtttcagcagaaactcgatacccgcaccagctcccggcagggtaaccgaacagattacaagtatcaatataataatgaacagagtcggcatcatgatcttggaagatttctcgatacctttctccacgcctttgacaataataaaatgagtaaccaacagaaacagaaccaaccacaagaccggtcgccacggactgctggagaactgctggaaggaagagatgaattctgtgggagtcttacccgtaaagccgttcgtaagagcttcatacacatactccagcgtccatcctgccactacggaataataactgagaatcagaaaagctgcgaggactcccatgcgtcccacccagcgccaatgagtgccgggagctaatttctgataggctcccgctgtatttgccctcgaacggcgtccgattaggaattcggcaatcaaaatgggaagtcccaaaaggaaaacgcatcctaaatagatcagtataaaggctgcgccaccgtgattacccgtttcatagggaaatctccagatgtttcccaatcctactgccgagccggcggaagcaagtattacgcctaatttacttccgaagttcgctctatcaattttcgtcataaatcttgttttgtcttacaaatcgttataaaatgtacgtattaaaatgcaaatatagaaaatgatagttatatttgtaccggaatcgtaattttatttagatatgctatcttatattaagaaatatcctatttcactttttatcatcttaactgtgatttatctgtctttcttcaaacctcctaaaacggacttgaatgaaatccctaacttagataaattagttcacatctgtatgtactttggtatgtcaggtatgttatggctggaatttctgcgggcgcatcgtcgtgatgacgcaccgttatggcacgcatgggtaggggcattcctctgtcccatactgttcagcggctgtgtggaattgctgcaagaatattgcacgacttatcggggaggagactggctggactttgccgccaactcggtgggtgccatccttgccagtttagtggcttattatgtggttcgtccgcgaatgatgagaagggaatagaagactatagtaatgcataatcatactcatgcctatgagaaaaaattctcattgcagtgagaaaatattctcataggcatgagtattttttctcatcgtggtgagaattttttctcaaaggcatgagaatactttgagaaattaacagcgatattatagataatctacaaccgaactgagcttaattccgttggaccctttgatcaggatagtgtatcctttcggcttgtcggcttccagttcctttattacttcctgtacgttgggataggtttggaaggagtgctctgctgctgcaaactgatctcctaccagccatactttttcgaacgcgcattctttgaggtagtctgctatcttctgatgttcggcagcgctttcggcacccagttcgcgcatatcaccaaggatgagcattttgtgaggaacttccatgttgcggaagttctgtaaggcagccatcatgctggtcggattggcgttgtatgcgtcgatgatcagtgtgttatcgtccgttttctttagttgcgagcggttgttctgtggtgtatatccggctaaggcttcgttgatctttgcatcttccactccgaagaagcggccgatggtgatggcagccagtgcattggggaagttgtattctccgatcagttgcgtctgaacctgataggatttaccatccttgcccgctttccattcgaaagtgaggtaaggggagttgccggtgattcgtccgtttacgtaaaggtcatcttcggtgccgtaagggatcaggttcagtccttcggcaatgttcatcagataagcattgtcgtgatggataaagacggtagaaccttctttcttacggagaaagtcataaagttctcctttggtttttatcacaccttcgaaagaaccgaagccttccaaatgggctttgcctacattggtgatgataccgcagtccggctctgcgatttcgctgaggaatttgatttctcccggatgattggcgcccatctcgatgacggcaaggtcgtgttccgctttcaggcggagcagggtagagggcacgccgatgtggttgttcagattacctagcgtataaagaatgttgtggctctgagagagtacggcggagatcagttccttcgtagtcgtcttgccgttggtaccagtgataccgattactcgtgtacccagctggcggcggtggtaattggcaagctgctgcaatgtttgcaggcagtcgtctacgagtatatatcgttgatcgccttcaatcgcgtattcggattcgtcgatgacagcataggcgcaaccggtttccaatgcttttccggcaaaagcgtttccattgaatgactcgcctttcagagcgataaacagtgatccttcaggacagttccgactatcggtcgtcactaattggcaatccagaaatatctggtaaagagcagaaagtttcatagcctgagcttttatttttaaatgttgcaaagataggctattctttcggatttggtatcggtcagaagcgttttttactcagcatataccaaaggaagagtcagcaccatccggcacccgtccgtataggatgaatcgatgtggaggctgcctcctaacttttcggcaatcgtccggctgatcgacagtccgaggcccgtgccctgtgagaaggagttcattttgtagaagcgttcgaatactttttcctgtttctccttagggattcctataccggtgtcggtaacgctgatctcgagtttcttttctgcttccaataccgaataagtcagttcgatgctgccatgagtcgtgaatttgatcgcattgtgtgccagattggcaagtaactgcgaaatgcgttccggattgctgagtatgattagtttttccctttccggtttgaaaaggaattcgactgtgtcttgtttctgcattttagctacttcgatagatagctggcagatcatattgatatccgtttggatatttgtagggagcttgttatattggtcgagctccgacaatgcgagcacatcggtcacgagtcgaagcagatcgtccgtgttggctttgatgatgttgacgaattctttcgtttcctcattgccgtagtggtcacttaatacttgtgagaagcctatgatcgaattgagcggtgtccgtatttcgtgagacatactctgaataaaagtcgttttcatctggctggtcgcttctgcctgatctctggctttgcgcagttcttctctcgaataagtcagttcttcgttcttatttcttaattcactttccgaggccttcagcctccggttcagacggctttcccgatataagaacaagaagaggatggctaacaggatgatcaatgaaaaaatcagcgtcgttttattgctcaactccttttcttttgtccgaagcattaattcctttttctccgcattgagcttttctacatttagcagcgtggcatattcgctgctcgccagttgttcattggctattttcaaagaatcgtctacttcaatatactttttcagaaatttcaccgcttcatccggtctgcccatctgtctgtagatttctcctttgaggcggtattgtccgctgctcatggcgtactcattcagccgttgctcttcggttttctgcttctcgacagcttccagtgccttgacgaactgtttgctgcgctggtagtagaaagcctctgtgcggtaaaacctttttttgagtgagtccagccttttgtcctggtcgaacagttccctgcattctttcagcatcttctccgctgctgagaaatctttaaattcactgtaatactctacgtatgtcagctttgccagtattttatggctggcggagttggctgtttttactgctttttccagtgcttccagcgctggttccggctgatgatgcgtaatgtagtaattggcaagttgagcgtaagtattactgatattatagttttctaatttgtatttttcggtcagttcgatttctttcacgcgccattcggacgccatgacatcaaagttcttgattgtgtaaatctgcgacatgatgttgtagcagtacatgagtccggtcttgttgtcctcggcttgtgcctctttcagcactttttcggcttcatagagggcgatgttactccttccggttttcaggtaatataggatcagccggttggcccaggcgaaatagtagtacttggactgctgtatttctttagcgaattgttttaccttattggtataaaaaatgatgctgtcttcattattggcctggtaataataatagtccagccgggtggagagagctaccgcctgcatccgctggtcgttttgtccgctagccatacggaacagcgtatcggacatactcagcacgaccggttccagcaaatgttcctggcaacgctgatagtaggcatacaaagaggaatcaacgttataaacttcagcttctttctgggcttttgcaggaataacgatgaacaaaaaagagacaaggtatcctaagataattcgggacaatcggctcatggtattcgttttcggtagttctattgattgctattgattgcaaatatacgtttatttcctaattttaatacgaatacttgctttttttatctacatttgcaacagtctaactggaatataatcaagaatgaaattgatctctccaacttatataaatgtgaaaggacgtctgctcgatcttgctactccgcaagtgatgggtattctcaatgtgacacccgattctttttattccggcagccggatgcagacgcaggaggaaattgcagcgagggcacggcagatcatcgatgaaggagcctctatcattgatatcggagcttactcctcgcgcccgaacgccgaacacatcaccgccgaagaagaaatgaaccgcttacgtaccggactggagatcgtaaaccggaatcatccggatgctatcgtttcggtcgatactttccgggcggatgtagccgaacagtgtgtggaggagtatggcgtagctatcgtcaatgatatcgctgccggtgagatggacaaccggatgtttgagactgtggcccgcctgggagtgccttatatcatgatgcacatgcagggaactccccaaaatatgcagaaagaaccccattatgataatttgatgaaggaagtgttcatgtactttgctcgcaaggtgcaacaacttcgtgaattgggtctgaaagacattatactcgatccgggttttggttttgggaagacactggagcataattatgagttgatggctcacctggaagagttcagcattttcgaacttccactgttagtcggtgtttcccggaaatcaatgatttataaactattgggaggaactccgcaggattcattgaatggaacaaccgtactggataccgttgcgttaatgaaaggagcgaacattcttcgggtgcatgacgtgcgcgaagcggtggaagccgtccggattgtggataaactgagaactgagagtgaatatggcaaatgatagaatggcattatccgttggtgatactctcttgtcgtttgtgaattaataacttgtaataagtaataagtaccgtgttttttgacgttggcataaaagattttatcgatgtactgctggtcgcccttctgttgtactacacctacaaactgatgaaggcctccggctctatcaaggtttttaccggcattctggtttttatcctgatctggctggtggtcactcagattctggagatgaaactgctgggctccatattcgataccttgatgaatgtgggtgtgattgctttgatcgtcctttttcaggatgagattcgtcgtttcctcttgacgctgggctcgcatcggcatgtcagtgcattggcgcattttttcagcggggcgaggaaagaagccttgaaacatgatgatatcatgccggtggtaatggcttgcctgagcatgggaaagcagaaagtaggcgcattgattgtgatcgagcataccactccgctggatgaagtggtccgtacgggagaaattatagatgcggctatcagccagcgtctgattgagaatatatttttcaagaacagtcctctgcacgacggagcaatggttatcagcaaaaaacggatcaaagccgcaggctgtatcctgccagtctctcacgacctgaacatcccgaaagaactgggcttgcgtcaccgtgcggctatgggcatctcgcagaaatcggatgcgcacgccatcatcgtctccgaagagacaggagctatttctgtagcttatcgcggacaattctatcttcgtctgaatgccgaagaactggaaagtctgctgacaaaagaaaactgaaactaaatataagtgaacatggacagacgaaattttctaaaaaccggaggtatagctctactcggatcattggcgacaggttctgctatggctctgactaccccgggtgcattgggcggcgaaggagctgacaagaaagcagcagttgctttggctatgaatcatttcggagtaagcgaggcagacttgaagaaggtgcttgccgcggcattggagaaaggaggcgattatgccgaccttttctttgaacacacgatatccaacagcatccgcctgatggatggtgcagtgaacaacagttattcgaatattgactatggagtcggagtccgtgtactgactggagaccagagtggctatgcctacgtggagaatattactgtggaggatatgctgaaagctgcccgtactgccgcccgcatcgcttccgccaacaaaggcaacaaaccgctgaatctcaccgaaaaggaactgaagaagaactattataccgttgcttccccgtgggaggaagtcagtttgaaagataagatgccttatctgcaaaaactgaacgaccggattttcgctttggacaaacgggtacataaagtacaggcaagtcagagcgataccacttcgcatatcttcttctgcaattcggagggagtgatgttctacgattaccgtccgatggtgacgctgggtgccgtgtgcatcatggaagaagacggaaagacggagaacggctacgctgcccgtgcttaccgcagaggattcgatttcctgtcggacgaggtagtggacgtaatcgcccgcgaagcggtagaccagacttctcttctgttcaaggctatcaaacccaaaggcggtgaaatgcctgttgtcatgggtgccggaggatcgggtatcttgcttcacgaggctatcggacatacttttgaggcggacttcaaccggaagaatgtttccatatttgccgatcagctgaataagaaagtatgcaacgaacatatcaacgtggtggatgacggtacgattccgttcaatcggggttcggtgaatttcgacgatgaaggtgccgaaggacagaaaacttatctgattaaagacggagtactgactagttatctgcacgaccgtatcagtgcaaagcactacggagtggaaccaaccggcaacggacgtcgcgaatcgttccgcaatatgccgataccccgtatgcgtgctacatatatggaagccggaaatgtgagcgaatcggatatcatttcttctgtaaagaagggaatctttgtagataactttacgaacggtcaggtacagatcggtgccggagactttacattctttgtgaagtcgggctacatgatcgaagacggtaaactgacgcaaccgatcaaggacattaatattatcggtaacggtccgaaagctttggcggatatcacgatggtagctaccaatgcgaagatcgacaacggtacatggacttgcggaaaagacggacaatcctgtccggtgacttgcggtatgccttcagccttggttagcaaactgactgtcggtggagagaactagaagtaaatgcttactttaaaaagacgaacctatgattacagacgaaaataagaaactggcacagtgggcgatggactacgccttgaagaatggctgccaggcagcaaaagtccttttatactcttcttcgaacacttctttcgaactgcgcgatgcgaagatggacagattgcaacaggcatcggaaggcggattaagcctttccctgtatgtggacggacgttatggtagtatctctaccaaccgcctgaaccggaaagagctcgaaacatttatcaaaaacggaatagactctacacgctatctggctaaagatgaggcgcgtgtattggcggacccttcccgttactataaaggtgggaaaccggacttaaagctatatgatgccaagttcgcatccttaaatccggacgataaaatagagatggcgaaagccgtagcggaagaagcactaggcaaggacgaacggatcatctctgtcggttcttcctatggcgatggcgaggactttgcttaccgcctgatcagcaatggtttcgaaggagaaaccaaaagtacgtggtactcactttctgccgacatcacgatcagaggggaaggcgaggcgcgtccttctgcttattggtatgagtcgtcgctttatatgaacgatctgattaagaaaggaatcggtcagaaagcgctggaacgtgtattacgcaaactgggacaaaagaaagtacagtccggcaaatatacgatggtggtcgatccgatgaattccagccgtttgctaagtccgatgatcagtgcgctgaacggctcggctttgcaacagaaaaactcattcttattaaataaattgaatgaaaagatagctagtgaccggctgactttgacggacgaacctcatttggtgaaagcttccggcgcccgctacttcgacaacgaaggtattgctacggaacgtcgctccatctttgacaagggagtactgaatacctatttcattgatacctacaatgctaagaagatgggagtcgatccgactatcagcggttcatctattttggtcatggaaacgggagataagaatctggatggactgattgccggagtggaaaaaggtatcctcgttacgggctttaatggtggtaacaacaacagttcgaccggagatttctcttatggcatcgaaggtttcctgattgagaatggaaaactgacgcaaccggtatccgagatgaatgttaccggcaatctgattaccttgtggaactcgttggttgcaaccggaaacgacccgcgtctgaactcctcctggcgtatcccttcactggtatttgagggagtcgatttcagcggattgtagacactgactttgaatagacttaagtaatggtcaggagatgatggtcataaaatggagatcatctcctgaccattactgtaatattaccctctgaattttataaatataccctgctataccccgtcttctgcctaactaatgctttattaattaacgtattatctggtttttgcttacctgtatttataccccctctttgtttgctaatttgtgggatgctgtttacttttgcctgtgtcaaaattaaataggatataactattgaaaactgatatacacacaaaagtaaaagcatgggaattatatattttggatcgggacttatactgctaatcgcactttggtatatttgggcagtcaacaatttgatcgctaagcgaaacagggtgaagcaatgtcgtagcggtatttgcgtggcattaaagcagcgaaatgacatgatacctaatttggtggccgccgttaagtcatatatgggtcatgaaaatgaaattcttacccgcattacggaacttcgatcacattctttccaaccttcacaggaagccgaacaaataaaaagtggcaatgaattgtccggtctgttaaccaaattacagttgtcggtcgagaattaccctgaactgaaagcgaatgaacaattccatcgcctgcaaaacagtattgaggacatggaactgcaactgcaagccatccggcgcacctataatgcggcagtaacagactacaataataccatcgagatgtttccttcttccgttgttgcccgtcagcaaggtcatcatcaggaagaactgattgatattcccgaaccggaacaacagaatgtaaatgtcgccgaacttctcagataatacgaatatggacacaattgattttaagaaattatcagaacagcttcgttcggagcttttacgggtaaatggctggagaaaggtggtacgaacaggaagtattgcagtttatctttttgtattctgctggtttatgtttgtgttgtttggcggtgcgcttgtatcttatataggtcttgagaactatatgcagtttacgcagtatataataccagtattcattggatttatagtggtcaacttcgttttcactcgctgcatggcgaactttcaggaacgggagtcggaggctatgcagcacattatgtctaccctgtttcctaccgtttatttctcggcttcctctcaggtagacagccggatattgagagacagcaaactcttttccgcctctttttctgatccggcactggcagccaatacgtatggatatatccagtttccgcacggcgagcactctttgcatgtggcggatatcggcgtgtcttacgggctgttgaacaagttgcagtacaatcctgtattgggatattttgtcatgatctaccgttttgtgcttcgtccgctgtttgcttcgcggctggatagcagtccgcacaattttcgggggatgtttggctggtgtaagatagacaagcgattcaaaggaaatattatcatattgcccgatcacctggaacaaaagatcggatatctggcgaagaatatccaggggttgaagaagcgctatagtgcccgactggtgcaattggaagatcaggagtttgagaactattttgccgtttatgccgatgatgaagtagaagcacgtatgttgctcactcctgcgatgatgcgtcatatgacggcgctgcaccagactttcggatgtgatatcatgctttcgttcagcagaggtactttctactatgccgccgtgatgccttccggttttttatgtgtgcgtccaagtgcgttgaatgacgggaagctgcttgaggacatatataatgatatcagcctgtcctgcaaagtggcagaggaattaagattgaattagtattaacaataaaacaaaaacactatttatgacagacatgagttggatgccttgggtcgtaggcggagtaatggtcctttcttttctttatatgaaggtatggccatttgtccgtactattataagagcttttcgggggcctcgttttaaatcaaaatcaaaattatccgtagaacagtataaaaaactgtctataggttcattgtatgccttgcagcaaggcggatatctgaacactctctcgttggatatcaaagataagttgcctactattcttggtgaatggtggggaataaataatgctcatgatgcccgcgaaacattggatgatttgtgccggaaaggttacgattactactttccgtttgtttatgaggcttttttgcttgacgatgaaaatgcgcaagacgatattttccagcagaacatggagagtcaggaagattatgaaaaagctgtcgggcaactgcaaaatttgaaagaggtctatgaggagttgatagcttatgaagtgattacttctaaagaagatatagcccgctatggagtgattggctgggatgccggcagaattaattttgttgcccgtgcctgctgcgatatgaaatatatctcagaaatggaagcgtggaattatatcgacaaggcgtatgaactggctcattcttcttttacatcatggcacgatatggcgatgagttatgttattggcagggctatctggggagggaccaatgctcacaatttaggaatgaagggaatggcagacgatctgttgtctaatcctaagagcccttgggtgcaaatcaaatggtaaattgatcaagatagtttaatcacaaaaacacataattatggaacaaaagaacaacaagtactacagttacatcagcgagtattatgccgccaacccgactaaatttgaaaaaagaaagaacaatctgaaacctgtgttatatttaggtttggccgtggtaggagccgttctggctatttttcccggtttgcttccattggcaggctggttggtgcgtacagccggaatcatcatgacactggtttgcctgatagctgcctatctgaataactttgatatatacaactttcaaagtggaggaaaagtcaagagtatgggagtcaagaagtttaagcgtgatgagacaaaccctgcgaagatagtggaagctttcttatccaggaactttgaatatctggcagaccttcccggaggaagaagtgaaccggtacaacttcatattgaagaagacgccacaggacgtgaaatgtactgtttgctgaccacttatgattcagattcgaatattgtaggtttggcagatgtcatcactttatcgggtaatgattatgatgataatattgatctaattaaacaaatgtttaaagacgaagaagataattgattcatcggggctggattataaaaacagctctgaggagaagaaaactcttctaaatggaagaaaaaacacaagaaagaaaaacattcatactataaaggaaatcgaccggaggggtgggtacagacacaagtaacctgtcaacaaaaggtcgtatttcctttaaaaataatctgtctcaggggattttgctttatttctaaccttttttgaatgataattggtacctgcggtttaggtgaatcgcctatctttgccgtatactatatataattataattctatattgagataaaagccatgagacacagatttattgctttactagtactttttacagtcatctttttcagtagtgcagaggcgcagactactgcccgtaagtttgaggcaggcaagaatactttcttgctggacgggaagccgttcgtagtaaaagctgccgaactgcactatacccgtattccgcaagcctattgggatcatcgtattgagatgtgtaaggcgttgggaatgaacactatttgtatttatatcttctggaatatacacgaacaggaagaaggcaagtttgactttacaggtcagaatgatatcgctgccttctgtcgtgccgctcagaaacacggaatgtatgtcatcgtccgccccggtccgtatgtgtgtgcggaatgggaaatgggcggcctgccctggtggttgttgaagaagaaagatgtggcactgcgcacgctcgatccttattatatggaacgggtaggcatcttcatgaaagaagtcggtaagcaactggcgccgctacaggtaaataagggcggaaatattatcatggtgcaggtggagaacgaatacggttcttacggcactgacaagccttatgtttctgccgtacgcgacttggtgcgcgaatccggttttaccgatgtacctctcttccaatgcgactggagcagtaactttacacggaatgcactcgacgacctgatctggaccatcaacttcggaacaggcgccaatatagaccagcaattcaagaaactgaaagaacttcgtccggaaactccgttgatgtgcagcgagttctggagcggatggttcgaccactggggacggaaacatgaaacacgtcctgccaaagatatggtacagggcatcaaagaaatgctcgaccgcaacatctccttcagcctttatatgactcacggaggaacgactttcggacattggggtggtgccaacaatcctgcctactccgctatgtgcagttcttacgactacgatgccccgatcagcgaagccggatggacgacagagaaatactatctcctccgtgacctgctgaaaacgtatcttcctgccggtgaagcactgccggaagtccctgccgcaatgccggtcattgaagtacccgaatttcattttaccaaagtagctccgcttttctccaacttgccggatgccaagcagtcggtggatatccagccgatggagcaattcaaccaagggtggggaacaatcctgtaccgtaccacattgcccgaagcagtaacctcaggcactacattgaaaatcaccgaagtgcacgactgggcacaaatctacgctgatggcaagctgctggcccgtctcgaccgccgcaaaggagaatttaccactaccttgccggccttgaagaaaggtacgcaactggatattctggtagaggcaatgggacgtgtcaactttgataagtccatccacgaccggaagggaatcaccgaaaaggtagaactcctttcgggcaatcaggtgaaagaactgaagaactggactgtatataacttccccgtagactactcatttatcaagaacaagaactacaaggatacgaaaatattaccgattatgcctgcttactatcggtcatctttcaaactcgataaagtaggcgacactttcctcgacatgagcacatggggcaaaggtatggtatgggtgaacggtcatgcgatgggacgtttctgggaaatcggtccccagcagacacttttcataccgggctgctggctgaaagaaggcgagaatgaaatcctcgtcctcgacctgaaaggtccgacgaaatcatcaatcaaaggtctgaagaaaccgatcctcgacgtactccgcgagaaagcgccggaaacacaccgcaaggatggagaaaagttgaagctgacaggagaaaaggttgcgcacgaaggagccttcactccgggcaacggctggcaggaagtacgtttcgccgctccggtgaaaggacgtttcttctgtctggaagcactctctccgcaagccaataacaatattgccgctattgcagagttcgatgtgctgggagccgacggcaaacccgtatcccgcgaacattggaaaatccgttatgccgatagcgaagagacacgtagcggaaaccgtacggcggataagatattcgacttgcaggaatccactttctggatgactgttgacaatgtcgcttatccccaccaactggtaatcgacctgagcaaagtggaaacagtgacgggcttccgttatctgccccgtgccgaaaaggactttccgggcatgattcgtgaataccgcgtctatgtgaaaccgtctgatttcaagtattaaaccaataataagccaatatcggccttttgataataaagcattcactttataaataagcatttactctcaaatgaatatgaaaaaatatactttactcctggcactccttttagtaggagtgctgacaggatacagccagcaatctgcctacctgtttgtctatttcaccggaaacaggatgagtgaggaagccatccggatggctgtcagccccgatggatacaactactatgcattaaacggaaaccaaccggtcatcgattcccgtgaaatcagttctacgggtggagtgcgtgacccgcacattcttcgttgtgaagacggaaagacattttacatggtcgtaactgacatggtctccggcaatggatggagttccaaccgtgccatggtactgttgaaatcgaaagatctcgtcaactggacctccaacatcgtgaatatccagaagaaatacccgaatcaggaagatttgaagcgggtatgggcaccgcaaactatttatgataaagaagcgaagaaatacatggtctactggtcaatgcagcatggtaatggtccggacattatttattacgcatacgctaacaaagatttcaccgatatagaaggagaacccaaaactttgttcctcccgaagaatggcaaatcctgtattgacggagacatcatttataaagacggactttaccacctgttctataaaacggaaggagacggcaatggaattaaaaaagcaaccaccgcctccctgacttccggacaatggacagaatcggaagattataagcaacagacgaaagaagctgtagaaggtgccggcatcttcccgctgataggtacggacaagtacatcctgatgtacgatgtatatatgaaaggcaagtatcagtttacggaaagcaccgatttggagaatttcaaagtcatagacaatgccattagcatggacttccatccgcgccacggcaccgtaatgccgattactgacaaggaactgaaacgcttgtacaaggcctacggaaagcccgacaagatgtaaagccatcagatacaccatctaatatcccataaataaataccatgaaaaaactcctgttgttcattttgcttgtctgtgcaacagtacaggcctattcgcaagaatacccgaaagtcgttttatcgggtgactatccggacccttctgtcatgcgcgatggtgaggattattacatgactcattctcctttttactacgctcccggatttctcatctggcactcccgtgacttgatgaactgggaacccgtctgtcgcgtaatgcccgaatacgaaggctctgcaatggcgcccgacttattgaagtacaaaggaaaatactacatctattatccggccaaaggaacaaactgggtgatctgggcaaatgacatcaagggcccgtggagcaaacccatcgacctgaaagtgagtggcatcgaccccggacacatagccgatcaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacagatatttatatgttgacaaaggagaagtcatccgactgacggacgacggactggccaccatcggccaaaaacagaaagtgtacgaaggctggcgatatcccaatcactgggaaacggaatgtatgtgtctggaatcgccgaagctgaattaccataatggttattattacctgacttccgcacagggaggaacggccggtccggcaacaagccacatggcagttgccgcccgttcgaagagtgtcaccggaccgtgggaaaattctccctataatccggtagtgcatacctatagtgcccatgacaactggtggtcgaaaggacacggcacactgatcgacgatgtgaacggcaactggtggatcgtatatcatgcctatgccaaaggctatcacaccctgggacgctccaccctcatcgaaccgattgaatggaccgccgatggatggtatcgtaccaaatccaccgccactcccatcaagaccgatccgtccatcaaacacggactcagcctctcggatgacttcgaaggaccggaaccgggactccaatggactttctggaaagaatatgcccctcagtcgctcagcttcaagaaacagaccttatggatagatgcgaaaggaagtaccccttccgatgcccgcttactgctggccaccgccgaagacaagaattacgaaacacaggtggaagtcaacgtaggcaagggtaacacagccggacttcttctatattacagcgaaaaggcatacgctggagtcgtgtccgacggaaagaacttcactatctacagaaacgcggaaaacagctttaccctccctaacaagttgggcaaacgcttcctcgccaagatacagaatcagggaaacagtgtccggatagcagtcagcaaggacggcaaggaatggactacgctggtagaaaacatggatgtatctcagctgcaccataacaactacggcggcttctacgctttacgcatcggactgctttcctccggaaaaggcagcgccggcttccgtcagttccgttaccgtaacgccatcccgcaggaaaaggacatgggggcttacttgatggtcttccataaagacgagacgcacagcctttatatggccgtcagtgacgacggatatacatttactgccttgaacgacggcaaaccggtgatcgccggagataccatcgccctgcaaaaaggtatccgtgacccgcacatcttccgtggaccggacggagctttctacctttccatgaccgacctgcacatctatgcgcagaaagacggcttccgtgataccgaatgggaacgtgacggaaaagaatacggctggggaaacaaccgcggactcgtactgatgaaatcgtgggacctgatcaactggaaacgtaccaatgcccgtttcgacctgttatcggcaggcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaccggatagagacactcccgcaaatcctcttcgagtatcccaacgagaaaatatcggctatcgacggtgacatcaccaaggtaggcgaccggtatcgcatgttctacgtttcgcacgacggaggcgccggaatcaaacaggccgtgtcagaccgaatcaacggtgattacgaatatgaccctcgctggtacgacttcgaacccagggcctgcgaagctcccaacctctggaagcgtatcggagaagacaaatgggtattgatgtacgacgtctacggcatcaacccccataacttcgctttcatcgagacttccgacttcgtgaatttcaagaacctgggacgtttcaacgaaggagtgatgaagacgactaatttctcgtcgcccaaacacggcgcggtgatccatttgacaaaagaagaagccgccaaactgagaagtcattgggaaaacaggaaataacagagtatcagatcttttttagtgaatacatactctttttttgcagagatcttatattataatttataccatgaaacatttacttctactatttagtgtattattattatcattgcagccggccgcatttgccgcaacgcatgaaacgactgctactcccgattcagtatccctttttgcctacgccacccgaggtgacgacggccgtagcggactccgctttgcatggagcatggacggaaaacattggtttgaaataggacgaaactacggctatcttcgttgcgattacagccgttggggatcgcagaagaagatgctcgacccgaatctgaaacaactccccggcggggaatggctctgtgtctggaagttgaacgaccacgatggatacggtcaggccagatcaaaagacctgatctactgggaagctcagcaatatccccgtacgacttccgattttgaaggaacaagagtcaaagcaaagattgccggacacgaagaaacgggaactgtcagccaagtgccctggtcggtagtggacggactgacccaaacctacgaacggaaccaataccgtaactccctgtatggcgaacgccctgtacaggataaagaacgctttgccggactgaaatcggtcaaagccaccgtcacagcacaaccggaagaaacaaaagaaatcagcgacttattgatgggtatcttcttcgaagacatcaactactccgccgacggcggcctgtatgccgaactgatccagaaccgggacttcgaatacgagccgtccgaccgtgaaggggacaagaactggaacagcacccattcatggaagctggaaggagaaaacgccacctttaccatatcgacttcggaccctatccatccgaacaatccgcattatgccgtcttgaagacgaaccagccgggagccgccctgaccaacaccggttttgacggaatcgcccttaaagcaggcgagaaatatgatttctccctgtttgcccgtatcccggaaggtagcaagtccggaaaactactggtacgcctcgtagatgccgacggcaccgtacagggtgaaacgacagttaccgtctcttcccgttcgtggaaaacgtataaagcagtgctgacagcgaaagcgtccgccgatacccatctggaacttcacccgcaatcggcaggtgaaatcgaactggatatgatttctctcttcccgcagaatacattcaaaggcagaaagaacggtttgcgtcccgaccttgcacagacacttgccgatatgcacccgcgctttgtccgtttccccggaggctgcgtggctcatggagacggtttgaagaacatctatcaatggaaaaacaccatcggaccgctggaagcccgtaaacctgcccgtaacctttggggatatcatcagagcatgggactgggttattatgaatacttccagttctgcgaagatataggtgcggaaccgcttccggtgctggcggcaggtgtaccttgtcagaattccgcttgtcatggcgatttgagaggcggtcagcaaggcggtatcccgatgagcgagatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgaagacttgatcaccgatgtcttcgaagaacgcttcacgatgatataccttgctatcaaagagaaatatccggagataatcgttgtcggcacagtaggtcctttcaatgagggaacagactatgtggaaggctggaaactggcggacaaactcggtgttccgatggtagacgaacattattatcagtctccgggatggttcctgcacaatcaggacttctatgacaagtacgaccgctctaaaaagacgaaagtatatctgggcgaatatgccactcacatccccggacgcagagcgaatatggaaacagctttgaccgaagcactttatctggctgctttggaacggaatggagatgtagtgcacatgagttcttatgctcctctgctggcaaaagacgggcggacgcagtggaatccggacctgatctacttcaacaatcgggaagtaagaccgacaacgggatactatgtgcagaaactgtacggtcagaacgcaggcgaccattacatcccttcacagataaaccttgataatcaggacggtcgcgtaaaactccgtgttggttcttccatcgttcgtgatagtaagacgggggatgtgattgtgaaactggtgaatctgttgcccgtcagcatagagacggatgtccggttgccgggaatggatggtatccagtcttccgctacgcggactgtactggcaggtgcacccgagacgactccgcttccggtgacggatacgatagaggcaggaaccagcttcaagcaggaattgcctgcttattcgttcacggtcatccgcttgaagacacaaaagggaaaaaataagcaataaactggttttcaataggggttagtttattttgggggaggggtgctcacctatcatctccccctgtgggtaggggctgactaaaaagtcaatagtatcctaaatctcctccttcgggaaggaagagtacccgtagggggaggtggtaggtgaatacataatcctgtcatttacaaagaaataggaacaaacattatttttcctaccacctcggtcttcgaccactcctccttcccgaaggaggagattcgagatagaatcgactttttagtcagtccaggtttaggtattattgacttttgtaccttctcttttcttcttcataatagaaaagatggttttcatctttcaccgaatgggtagttcgtttgctgtctatagtgtaatcagccgtaagatagtactaaagttctctttaacctcttgcatctttgctttttcctatagggaaagtaggaataagacaccgatatctttagttgttcacggccgtgaacaggtctgatcacatccgtgaagagcattgctcacggtcgtgatcaactcttgccacggccgtgaacaactaacaatatcagtgtcttaatggaagaataaaggcactataagtgaaagataccggtagtatatggtatttgttgtataaggttaggggctggatataggggaacgtaataagtaacaagtaataggatggggaaaggtgacaataaaatgtgtgatgtatggctattgtcaccctattatcaccacttattatcacccaatgatggctaataatcagtaggttatcctcaaaaggtgataagtgacaataagaagtatgttttttactaaggaacacgagttcgatataatccaacaagatggaccatatcgaactcgtgttagttatctgattatcgtcagtttatagcttggcaatcactttcttacctctataggagatggatttgtcaaaggtggttgaatctccgtcgccacagccttttcccggttctacaactatgaggttgaatttgcggcttttcagcattcctttatagctgcctttccggtcgtcgatggtcagtgtacggtcttggtcgttccatttcaaggtgatggtggagtaagctcccttttcgtagttataattgtcgaactcatcttcgtaaagggtaaattccgcgttcgctcccggatagatacggatggtcagattgtcccatttcttttccgtagagtattgcacggcggtcccccaggggagaatagagccggcacggacgtagatcggcataatgtcaatcgggacttcacgttgcagggtctgtccgccttccagtgtttgcccggtccagaagtcgatccagcgggcaccttggggaaggtaaacatcggtctttccgattttgctcatgtctttctgatgaccgttttgcttcttgtcttgccatgtatacaatgaatccgtcaccgggcgaaccaggaagttgcgtccgaacatatattcggtgtccatatcgagcactttcttgtctttcgggaagtccatcatgagagggcgcatgatgctgcctgctttgctggtcacttcccaggaagtgctgtagatgtatggtaacaggcggtaacgtaagtgagtgtatttttccagtgcatcgtatgaccagtcgcctttcttgccgaactggtagatttctacggctaccggactggaattgtgtgaacgcatgatcggctggaatactccccactgataccagcggacgtgcagttcatgataggcgatgttgtttacgttattgttatatctccatgcgaagaagccacctaggtctgtgttccagtacgggatgccgcataacgcatagttcagtcctgccgctagttgcttgcgcatgacggaccattcggaagttacgtctccgctccatgaatgggaagcataccgttgctgtccgaggaaggaggaacgggtaagcaggaatacgcgtttgtcggaagtagtggcgcgttggtgttcgtatacgcctttgttggacattaaggggaaggcgttgtgtaccctgcggaaagaacccagataagtctgcgtgttgaagtcctggtctttgatatccatatggtccggttcggtggagtcgagccaccaggcgtccatgccgaggtcgaagatgttctttttcattgcttcccagtagatgtcccgtgctaccggattatacgggtcataaggttttactccggctttgggcggccacgtttcgaagtggagcagtgctttcagactgtccatcttctgatacatttctgtccacgggccgaaggaggcccatacggagatcatgatgtgggcgttctgcttgtgcacgtagtcgatcatttctttggggcttttgatgcggggagtgccgtagtcggcgtttttgtcttctccgttcgggaggaatttcatgtattccgggtcacccatcttattgatgtagcggggattctggaatttcatggagttccagttctcgttgcagccccagtattgccagtcttggatgattccatccagaggaactttcagctcccggtatttgtctacgacttcgcacagttcgtccggacttttgtagcgttcgcggcattgccagaagcccagtgtccagagaggatacaacggggcttgtccggtcaggtcgcgtactccggctatgactccgtcggcgttgccgccgtagatgaagtagtagtcggcacagtcgcctacttccgagtcgaaggaggtttcttgcggattgtcgaggaaggtggtaggagagtaattgtcccagtagagggcatagcctttgatggagtggatgaaggggatacagatactcatgttctggttgcggagaaagagtttctgattgcgttggttcactttgccggtctgctgttgccccagaccgtagatcacttcgtccttatccagcaggaaagcctgacggacattgtaggaggggacgcctgcgtcattgaaaggggtaaactgtgtaccgtagtctttgtcggtcagcagccgttgccctagtttgtcaaagaagtggatgccgcctgtttcggggttcacttccacttgtatcatctgactgctcaatgttacatttttcccgttttcaccgaaggaaaccggggtttgttccggtgctttgatgacaacgaggctttctttgtcggaagctgtctcgccgggcgttttatatacccggatgatggaaggcgaataaaattctacactgacgttcatcccttgtgctgcatacttgatgccttgggaagtgcgttgtacgttttgtgccgtaccgtttgcggcaatgatcatggcccatgccaacaggatgcctgtttttcttagattcattttcatggtttctttaagtgctttatgatacggcaaaggtaggatggaaggacgttttgcggacaatagctatgttgaaacaaacaacaatcaggttgatttcttcgctttctccgtatattccgagggacggcatccatacatttcttgaaaacatttgcttaggtagctggaactgctgaagccggtacgctccgctatttcggttacgctcagtttgccttcggcaagtagttgcgctgctcgttggaggcggatgttgcggataaagaggctgggggactggtcgagcaaagtcaccagtttgcggtagagtccggtgcgttccatgcagaggtcacggcttagttgctctacggagtagccgttgacgtcaaggttcttttctaccagttctatcgcttgcactaaaaaggcggattctgcactgtccggttctatgccgtttggcttttcattatcatctgccgtttcgttcctgtcgcagacggaagggtggcttttcttctccgaacgggctttctgttcggcttcatagctgttgcattgctctatcaggttgcggatgcggagcagcaggatttcttctttatgttgctgtttcatctttttcttggtctgatagatatagaggcggatgcttgctaagacaatcagtaacacgaaggccgtatacagaacgtaggcggtagtcgttttccaccagggagcgtggatagtgacgtgtatctttgtgatgttatcgttccattgtaacaggttgtcggatgcagcgactttgaatgtataatctcccggcggtagattggtataggatgcctgcaggatgccgttgccgactgttgcattcccttgtccgctggcgaaagcgttcatccattgtttgtcgatgccttccagttggtagcggtagtaggtgcgttcgctgttcacgtagttcagtgccgaacattcgaaggtcagaaagttctggttgtagtccagttctaggtcctttgtgtaaggggcggcttgtggcaggatgatgcggtttccgtacttttctcccgtgtttactttttcaccgtagagatgtaagttggtgaaaaccggtttgtaaggcaggcccggagtggcggatttatggtcgggacggaaaatggtaaagccgtcgatgcctccgaaatagagtgtaccgtccgaagactcaaagatagctccctgtatatattcctcttctaaagccccgtccagttgattgaagttggtaaagccgatttcctgattctccggattgatatggatgcgtgaaatgccattgctggtagttacccagatatagttgtttctgtcttcgatgattgattgtacgaagttattgctcagtccgttttcacgatagaaaatgcggtgggcttgtttattaggtgaggcggattgattatctgctgtttgtgtggtcggtttgctgtccggtgtttgctcttgatcggtgaagagttccagtccatcggctgtccctgcccatgtccagccccgtgtgtcggtgcatagagcggtgtatgattggcctctgtaatatttgtttccccccctttgatctaattcctttgccaattctgcagagaccgatgaggctggtacaggtagcagagtccgtgaaccgtcctgatcgacagctaactgatagattgtggaatggcttttcagatagatattgccgttatcatcttctgcaaaagctttgacagcgacatcctcttccggtgatgcggggaaagcagtgcggctgacgtgaatcagtttgtgtgtggcaggatgatgatagagtaatccccgattgagtgtgccgacccataacccgccttgggcatcctgaaagatggtgctgacttcggtcgaaacgagctttcccttctttgtttccagtacggggatgtattgctgttccctgctttcgaggtcgatgatccagaaaccgtggacacaactgatatatgctttatcgccctgtggagtgatgatcagggtgttgagcgtgtagttctgttcgaacagcttttcccatgtccggttttggggattaaagtagaagaatcctcctttgcggccgttgcgtaactggtagaatccttttttgcttttgacaacgagagaagtacggttgaagttctcctgttcggaggcgggataagcagctctgtcatacaactgtttcccggttttcgggtcgtagcaaacgacttcaccggtatgatagaataggtaaaccgcaagttcatccgaatgtatgtcctgtagctttcgatgttcattctccggcagggtgagacggatgcctgtttccagttcccgcaactcttgggaagtaagtagccagatacgtcccgaattgtcgacgaaaaggtcttctaccggttcgtgtatctcttttctgcggaaataggagtcaaggtgaggtatgtatttttcttgatggagatcgatgcacatcagtttatgataatctttaatccataggagtgaatctccgcattgatagatgcggtaacatccttcatactgtttcagcggggaaacgtcttctgccgtgcggtgaaggtagctgaaatgtaagccgtcatacagattgacattcccgttggtggtgaataccattcttccgtcggggagttggagtatgtagcgtatttggttgtcgctcaatccttgtgccgtgttgatcgatgtaaacaggaagtcgttggcgtccaccgtcagtgtcatcctgatacacaggaggaggaatagtagtattcgggtgtttttctggttatttgccgccattgggataaggattatgatgttcgatgatgcaaagataaaaaaagtcggggttatacttggataaactgttctttttgtaaagggtttcgggagggaatgtctgcatatcaatcaaaaaaggggggaaatcatgcaaacgatgaaagtttgtatgcgaatataattatattctctatttttgcttttgttacaatgaggacatttaatcataaaagaaaaataatattatgaagaaacttgtaagcactttgacagcgattcttggtataagcactcttgcagcacaggatgtggttgtaaaaggaccggacgaaaagttgcagttggcggtatttgtgcaaaacgagacgaagccttgttattctgtgagttacaacggaaagacgatgttggaaaagtctcctttaggcatgaataccaatatcggtgattttacgaagaatcttaaactgaccggacattccgtcgacaagatcgatactgtttatcaacagacacgtatcaaagtttccaacgtacattaccgtgccaatgaactgacttgtcatttagagaatgagcagggacaaaagctgggagttatttttcgggtgagtgataatgatgtggctttccgctatactttgccgcatcagggaggaaaagcgagtgtgacggtgaaggaagaacaaacaggtttccgctttccggagcagactactactttcttgtgtccgcagagcgatgcgatgattggctggaaacgtacgaaacccagttatgaagaagaatataaagcggatgcgccgatgagcgaccgttcgcagtacggacatgggtatacgttcccttgtttgtttcgtataggaaatgacggttgggtgctggtcagcgagacgggtgtggacagtcgttattgcggttcacgtttgagtgatgtgagtgaagggaatttatatacggtcgcctttccgatggcggaagaaaataatggaaacggaacggtcgctcctgcttttgcactgcccggcgctactccgtggcgtaccatcacagtgggagatcatctgaagccgattgtagaaacaaccgttccgtgggatgtggtaagcccgctttatgaaacaaaacatgattatcgtttcgggcgtggcacgtggagctggattctttggcaggacggcagtatcaactatgatgatcaggtacgttacattgattttgcttcggctatgggatatgagtatgcgttgatcgataactggtgggatactagaatcgggcatcagcgtatgaagtcgctggttgagtatgcacgcgataaaggtgtcgagttgttcttgtggtatagttcttccggctattggaatgacattgaacagggaccggtgaaccgaatggataatgcaatcattcgtaaacgtgaaatgaaatggctgcaaagtctcggtgtgaagggaatcaaggttgatttcttcggcggtgacaagcaggagacaatgcggctgtatgaagatattctgagtgatgcggacgatcacggattgatggtgattttccacggttgcacattacctcgcggatgggagcgtatgtatccgaattatgtgggcagtgaagcagtgctggcttcggaaaatatggtgttcaatcagcatttctgtgatgaggaagcgttcaatacttgcctgcatccgtttatccgcaatacggtgggatcgatggagtttggcggctgctttctgaataagcgcctgaaccgtaataacgacggcggtacaacacgccggactacggacgtgttccagttggcgactaccgttctgttgcagaatccggttcaaaactttgcactggctcctaacaatctgaaagatgttccggctgtttgcatggactttatgaagcgggtgcccacaacgtgggatgagacacggtttgtcgatggctatccggggaagtatgtggtgttggcccgtcgtcagggagatacctggtatctggcagctgtaaatgccggcaaagaaccgctgaaactaaaactggatttggaaatgtttgccggaaagacggtggctctttataaggatgataaaaagggagaaccggagttaacgtcactgaaagtgaaggaaaacggtaaggtgcagttggaaatccgccctcaaggaggtattctttgtataaagtagcctgtcaatatggtttatttgtaaatgctgttactttaaatatcggtattgtcttatcgtaaatcgtatttatcctattaaacttaccagaaaaaaagtacgtttgcattgtcttattcaactgtaatttttgtatgaatcaggcattaactttggataatagataatagtatgcaaaaacagatcttttttagttttgtgctggtaatgatgttggtagggaaagtgaaagctcagcacaataatccttttggcaatgcattgattccggatatgattgccgatgcgagtattcaggaaattaatggtgtcttttattgctatgccactactgatggctatgggcagggacttaaaacatcaggccctccggtagtatggaaatcaaaagactttgtacactggagttttgatggaacttacttcccttcggctgcaaaggagaagtattgggctcccagtaaagcaatttttgctaatggtaaatattatatatatcccactatcaatgggtatatgtatcctgctgtagctgataagcctgaaggaccgtttaaactggcacgtgggaaagacgaattctataagccttttactccttctactttattgcagagtaagaatccgggcgggattgatgctgaaatctttgttgacgacgatgggcaggcttatgtgttttggggacgaaggcatgtagccaaactcaacgaggatatgattacggtggattctgtagtacaggtaatttctactcctcgcaaggagtactctgagggacctatctttttcaaacgtaaaggaatatattattatttgtacactatcggaggggatgagaaatatcaatatgcgtatgtaatgagccgggtttcccctatgggaccttttgaagctcctgaacaggatataatatctactaccaattatgaacggggaatcttcggaccgggacatggttgtgtctttcatcctgagggtacggataattattatttcgcatatttagagtttggcaggcgaagtacaaaccgtcagacatatgtgaatcaactgaaatttaatgaagacggtacgattcgccctgtcgaactaacaatggatggagtgggggcattgaagaaggtgaaatcagataaaaaaatgaaaatagatacagtttatgcgtctagtattgaagtgccgttgaagattgaaccgatgaaagacccgacatgtctgcggacagaatattttgttccttcttttgcggtggacggagcaaatggttcccgatggatggctgctgccgaagatagtattaatccatggattgtggcagatttgggtactgtaaagaaggtcagacgcagtgaaatttattttgtacgccctactgccggacatgcttatgttattgaagcatcgatggatggaaaagtctggcaagagttcgctgtccatcaagataggaagatgtgttcaccacataccgatgtcttgaataaaaggttccgttatctgagaattaaaatcctaaaaggagtccccggtatctgggaatggaatatttattaataagccaaaagtgtatgaatataaaaatgaatatgaaagtccccacatgtattgtagtattgatttttactttgtcaacagtaaatgtatttgcacagaatgattacaagtgaggagaatggacaacttggggcgatcagggagatggcacctattgtaatcctgtccttccttccgattacagtgacattgattgtattcgtgtgggggatgattattatgctatttcttctacctttcaatattccccaggtatggtgatcatacattccaaggatttggtgaactggacgattaaaggtcatgtggtttctgatctgagacagatcagtgaagaaatgaactggacgcgtatgaatcgttatggccgaggtatttgggcaggggcaattcgttattatcagggaaaattctatgtgtatttcggtacaccggatgaaggttattttatgtcgacagctaccgatcctgcgggaccgtgggaaccgttgcactgtgtaaaagcagaaaagggatgggatgactgttgtcctttctttgacgatgacgggcaactatattttgtaggtacccattttgctgataaatacaaaacttacctgtaccggatgacacctgatgggaagaccttgatcgaaaactctaaaatattaattaatgaggggtatggtcgcgaggcaagtaaactttataaaatcaacggaacatattatcattttttcagtgaagttaaaaatggcggtagatatatcatgatgcaacgttcttcttcaattacaggaccgtatcttgaaaggaaacaattaagtcatgtacagcgtgaatataatgagcctaatcaaggcggacttgttgaaggtcctgacaggaagtggtatttttttacccaccatggtacgggtgactgggcaggtcggattgctagtctgctaccggtatattgggtcgatggttggccgattattggtgaggttgggcaggatggcattggcacaatggtatggcaagcggccaagccttccaatgagtatccggttcggactccacaatcatctgatgattttagcaagtcggtactttctcctcaatgggaatggaactaccagccccgggacgagatgtggtcattaacggaaagaccaggcaatttgcggttaaaagcttttcgtccattagtcacggataatttgctgaaagcgggaaataccttgactcagcgttgttttcgtacaaacaaaaatgaggttattgtaaaaatgaacattgagggcatggttgacggacagaaagccggactgtgtcattactctaagagttatgccatggtgggggtacgccagtccggcaaagaccggaatctggaatttcagaccaataaagagaaaatcacaggtcctgcgataaagggaaacaaggtgtggattaaatctgtatgggggctggatggaaaaagccaattttcatatagtacagatggcaggaagtttaccccgttcggagaggtatatcaacttgaatggggatattaccggggaagccgcattgggatttactgttttaataatatagcggatgcggggtatatcgatgtggatgagtttatttatttatattaactgtttagtgtatgaaacattcctttaattgtttaagttatgaattactgctttatgtgctcatttgtattccattctgttcttgttctcaaaaagatacaggtgtgatttctcctaatgggaagatatgtctttctgttgaaataaaggaagatactgaaaaagacggttttggcaaagtcttttttaatgtagagtacaaagatggtaaaacttccagaagggttctatctgatacccgaattggcttggaaacccagcttatgtcatttaccgataacatcaggttgaaatctgtgtccggtactaaactaattgaagatgattatgtgatgcttaccggtaaaagaagtcattgtcagaatagaggaaatgaaaggatatttcggtttgagaatgagaaggcagaaaccttagatatcgttttcagggcttacgatgacgggattgtatttcgatatagcttaccatctgttcaagataaggatagtctgacatctgaacatacagcttactatattccagaaggaacgaaaagatggatacagaattattctgttggttatgaaggtttctatccattgaaaaccagagcagaaagaggcaaagacaatatgtggggctatccattacttttggaaccagccgattcattgtttgtgttgataactgaggccaatatacttcgtggacatagtggttccagattgtataatggaaatgatatgaatcaatatcaagtgcggatgacagatgataaattagccttgggtgattcattcacatcgccatggagagttcttatgataggttctttgtctgatattgtagaatctactttggtaacagatgtctctgaacctaacaaaatttctgatacaagttggattatgccgggctctgcatcatgggtatactgggcgcataatcatggttccaaaaatttcaagattgtaaaagactacattgacttggctgttgatatgaagtggccatatagtctgatagatgcggaatggaatgaaatgtcaaacggtggagatattgaagatttgataacctattctcttagtcgaaatataaagcctatgatttggtataattcgtcaactgcttggatggggccgggtcctctttaccgcttgaatagtaaggaaaacagaataaaggaatatacttggcttcaaaagtcaggtgtagtaggggttaagattgatttttttcctgatgattattcgtctaatatggattattatattgatttgctggaagatgcagctaaatataaattaatggtcaattttcatggagctactattcctcgtggatggcaaaggacttatcctcatctgatgactatggaagccgtttatggggcagagtggtataacaataagccaatacttacagatcgtgctgctgaacataatgtaacattgccatttaccagaaatgtcattggctcaatggattatacacctggtacattctctgattcccaacatcctcatatcactacttgtgggcatgaactagctttgtctgttgtgtttgagtcagcattgcagcatatgcctgataggccggaggtgtacagttcattacctcgaaaagtaagagaattcctttcgggattacctactgcttgggatgatacaaaactgttgtgtggctatccgggtgctgacatcgtactggcacgacgtaagggagatgtatggtatattggaggattgaacggaactaacgagaataaaactctttctttttcattggttcctctgcaagttgaaggaaaaacgatggatgtatttaaggatggggtggacgataagagttttgccatcgaagaagacatccagttatcaaacgataaaatggatatgtcatgtcttcctcgtggaggatttgtggcagtaataaagtaaggataataaatgatattgttttaaaagtcgatattgttttattgtaaatcgtattcatcctattttttttcactaaaaaagcgctacgtttgcattatataattcaatcgtaatatttatgaaagcaaaaaaattactattactatccttgttatttatagcggagactttatctgctcaaaactatcaggttcctgtttcggagcaagatgaacctatgatgcaagggaaattccagcctacttgggaatcattggctaattataaaataccggaatggtttagaaatgtaaagtttggcatttgggctcattggggcccccaatgtgtggaaggatctggcgattggatggctcgttctttgtatatggaaaattcgcctgaatatcgacatcatatagcgaactacggtcatccttctgaatttggctttaaagatattattccgttatggaaggctgaaaaatgggaccccgataagttggttgcattttataaaaaaataggtgctcagtatttttttgctttgggtaaccatcatgataatatggacctttgggatagtaagtatcaaccatggaactcggttaatatggggcctaaaaaagatatattgaaaggatgggaaagagcagcgcgtaaacatggactttattttggggtcagtctgcatgcagaccatgcctggagttggtatgagacttcccaaagacacgatactcaaggtcctaaaaaaggtattccgtatgatgggaaattaacgaaagctgatggaaaaggaaagtggtgggaaggatatgatcctcaggacttgtatgctcagaatcatccgttaagtcaggatagttgggataatggtacaattcataggcaatgggcatggggaaatggagtttgtttaccaacacaggaatattgcactaatttctataatcgtacacttgatgtaataaaccgttataatccggatttgttgtattttgatgtaactgttgcacctttttatcctataagtgatgcaggcttaaaaattgcggctcatttttataatcataatatgtcaatgcaaaagggtaaattgaatgccgtaatgtttggtaagattcttgatgcaaatcaacgtaaagctttggtatgggacgtagaacgtggagctcctaataaaataatagatgaaccttggcagtcatgttcgtgccttggcgggtggcattataatacgtctatttataataataatcaatataagtcggcagctgacgtagtgaagctgttagttgatattgtcagtaaaaatggtaacttacttctgagtgtcccgttgcgtgcagatggtacatttgatgaaaaagaagaaaagatattgaatgaatttggtaattggatgaatatcaataaggaagcaatctatcaaacgcgtccatggaaaatatttggtgagggacctatagcggataaagatgttcaactcaacgcccaggggtttaacgaatgggcctatagtaaagctgatgcaaaggaaatacgttttacacaaacagataaaaatttgtatgctacagttttaggatggcctgaagatgggaaaatcttaattaggtctttagcggaaggtaacgggttatatcccactaaaataggcagagtagagttgcttggttacggaaaagtatcttttacacgtactgataagggacttgttgttgatatacccgctaaatcgttgaagaatatagcccctgtcttgaaaattagaaaataaaagttattactatgtcgtctattcagggatacaaaatgaaagagtatagcatgcctacaaagaggtattgccaaactttaagccttaaaaataatccgattctgattgaagagtatcgtaagatacatagtgaagaaaaggcatggccggaaataagggcggggatacgtgcagtagggattctggaaatggaaatttatatattgggatcacaactttttatgattatagaaactccactggactttgattgggagatagctatggataaactgtctaatcttccgcggcaggctgagtgggaaaagtatgtgtctaaatttcaagactgtccgtatttgagttcttctgctgaaaaatggaagttgatggaacgtatgttttatctgtatgaagattagttgaggataacgtaatcgtttactacgtgttgagaaaaaaggaatagtgtgaaagttgctattcctttttttctgcttaagagtgataagaggtgcgatattcttggggagtaatacctgtgatttttttgaataacctgttgaagtatgaataatcttcaaaagcaagatttaatgcaacatttttgattgacatatcatcggttattagtatgagttgagctttttctattttcttacggttaatgtattttaagggggtatctcctgtctcttttttgaatagacgaataaaatggtcttttgataaacaggaattctcagcgagtactcttaaatcaatagtttcatttatatgtttacggatatagtgaatggcttcttctatccgattgtcttttaattccatttttacttgagctctttttaggaaacgtgctagcaattgatatacaatacctcttgattctatcttatcagacaaggtccgttgtttgttttttagcagattctgcataagggtgtaattgttatcgtaagaagtcgggtctgatttctgtaaggtcatatgtggatttatagtgcagagccgctgaaataatgccaaatctatttcgacagcggggatttctattggaaaatcccaattgtccagtaagttgctgtctgactggtgttcttcatatatatgcagataatagtgggaaaaataagagttgcagatatagctatgtttggtaaaagctggaataaaatacatgtggttagcttttagaatctgagttttacccgatattaagacttgtgcagtaccttctgtcacataatataaacgtgtaaaagggctattgacatttttccagttccaatcggcattatgaatagccaaacctatgttcaaaacaagcgggtgcaatttatcaacaaatgaagccatagcatatagggtttattaatgtgaagataaagatcagttatacttgcaagactctgagttatcttatctttaattttcatatctccaataatatataacaaaaatacaaaatatatttcagaaaggtaaaagaacaggctttaataataccattaatgaatgtaatgagagcaactatcgacaaaattcctctttttctatgtagctcctcctgcaaatttcatcaatcgccttattataacaactacaaggttcagtactacgatattccaatgtcagggcttgataaaaaatattaagagattggtcgcttcctatccttggttgcataatctttacgcattttaattctaaatattgcctccatattagcaaatccttatttttccctagcaaacttttgacacctcaacagcataaacagtatttatgggataattttagaaaagctgaaacgagtaagcaaagaattattctatttccttaattcgttcaatctgtctatccagaaaataatcagtatataggctgtagtcttccatttcataaaacgctatcagtccttttctgtaattcagtatatccgaatctttgacaggatatacgggaatgatgccaacattcatcaaagaaatactttctatcattcttgcagtccgtttgtccccgtttgaaaatctcatcaaacgacaactgaaaggccatgacatacatcaaacatcatcccggccggattgcactcattttgctaaatacaggaagcgatctatagcttattgtcgaagatatgttacaagagaatgtatatatcctgtgatctggtgaagcggaagctcaggaaccgggttatagtagacagattggaactaaagctatgtacacactgcgagaaaactcttccgttacaccggttttacgctggcaggatatatatggtcaattttaaacattatagtaatgccatgaggaatagatatggatacaataagagcaattgaaggagagttatcgatacaaaacttcaagaagatattaaacatatataaataagacaggattattttttttacgtcatttttttatctatattaaaggtcagagaataaaccaacaattttaaatactttaaagagatccaagcaaataacaaaaacatattttacacaacgccttaaagtccgaaaaatagtaacattatttaaaatccagtagttatgaaaacaattaattatttttccggctcattgcttgcattattattttatgcactatttgctgcatgtaataatgatttgcaaactattgctgtcactgaaataaaaggaatagaacaaactctcttaaacgaaagcaatactttaataagttcagatgtagcaacagatagtactatgcttggtaaagacaacacaatatccaactcaacgtctgctactaatgcattcttcactaaacaagaatatgaagaggggatggattggtggaaagatagagaaggtgcgctacctgctctatatgaatatcaggtatcctgtcgtgattttccttctggacatggtcctgatacttgcatatattatatgaccattatttggacttgttatcctcctattacagaagctaattggatggattatcaatatatgcaagtacaacataggctaataagtggtactactgcatttccttggcgttatttaggtgaagggggcccggggaattataattatggaatagtgaaagtcaatggatttcaagatcctatggatttaaatgctacacatttgcctactagagttcagtttagatatagattgttgcataaagatttcccagggaaagcagataaaagtattaatgataaagaaaaatggtacaataaaaaccttgcaactggatggcattataaagattacaatcagccaacttataataacccttatggttataattcacaggatttcaacaatatggaatcactaaaattcataattaatgatcctaagtgtggctcatctttttctgtaagagtgcttgttgatggatatttagtttttccccaattagtaggcggaagatatgaagttactgttccaaaatttaggaagactggagaatatctcataacagctgaatacgcaggcaatgtttcggaagaatttaaaactgcagtgcgacacggtatctatcaaaaatatacaagcaaagaaatttatatcatgtttagttgcaatgagtttagctatgattaacaaccttacatgtcacaataatgaaacgaatacttttaattctattttgcagtctacatagcattttgtttctccgttcacaaaacgctagcagcgacatcatcttcaaacagttcttcgataatgccgttgcttttgctgacacatacccacgtgagaaggtatacttgcattttgataatagtagttattatgtaggagatactatatggtttaaagcctacacggtatatgctgagaacaatatgccaagcaccatcagcaaacccctttatgtagaaatgctcgaccagacagggcatattacccaacgccaaatcattgaattgaatagcggtgaaggacatggacagataatcctgaatgaaagtaccatgtccggctattatgaaatcagagcttacacccgttggatgctcgcattcagcgaaccttcttacttctcacgtacattcccgatctatcagtctgcacaagaagaaagaccagaacggaggatttcgacctataatctgaatccttccatgaaacagcgaccgaaaaatgtgacagataaacttgctatccaattctttcccgaaggaggaacactcgtgaaaggcatctcttctcgtgtggcatttaaagctgaaagtagagaagatggtaatgttatccttgaaggtgccatttatacgaaagacggggaaaagctgacagaaataaaaaccctacatgacggaatgggaatattcacttatacacccgaagaaaaaccagcagtagctaaagtaacttataaagaaaaagaatataaattcaatctaccggacgccctttccgccggatatgtattgaacgtgaataattcaagcggagctattgtaggtaacgtattgagcaatgagaataccccggatgcagacattgtagcattcataagtcatgaaggtcgcccctattcgtattggatactacgaatgagatcaggtggaaatcaaactttcttacttaaaacgcgcgatcttcccggaggcatataccaagtcagtctactagacaaaaccgggaatatgctgtgcgaacgatttacatttgtgcaacccaataaattgaattcaatacaattaaatggaattaaagacatttaccggcctttcgaaccaattcgctgcgaaatacaagtaacagatcaaaaaggaaatcctttacaaggttctttatccatatcagtaagagatgctatacgttcggattatgcagaatatgataataatatatttacagatatgttattaacatccggtttaaaaggatatattgataaaccggggtattattttgcagatattacacttcgcaaattgcaagaacttgatgttttgctcatggttcacggttggcgtcaatatgacttatcacaacttatttccggtaaaaatgaaaagctacttcaacagtcagctgaaaaagagttgttactacaaggacagattcgttcttctctattaaaaaaagaaatgaaagatatggaggtaagcgtcatggctaaagtggacaatacatttgtagcaggaaatacgtttacagatgaaaacggcaaatttcaacttccggttactagttttgaaggagaagtagaagcggtattccagatacgccgtaggggatctaaacataagaaagatgcttctgttatgctcgaccgtaacttcgcccctaccccacgtgccttcagctatgaagaagaacatccacagtggatggacaaaaactcatggatcaccctttccaaccgtatagactcgctatatgtagattctattagcaaaactaacaacacctatttattgagcgaagtggaaatagcaaaaaaaagaaaaaataagaacatcactactcaagtattcgagaaaagcgtagacgcatactatgatgtaacgcgattggttgatgaattacgcgatcagggaatagtaattaatactatacccgacttgcttagtaaagtgaatcctaacttttcatacgatgtgcaagacggaagctcacgatataaagagaaaacaatctgtctcattgttggcaaacaagtacttgatactttaactgcttggacattgtggaatgagatagatggtataaaacagattatgatatgcgaaggaagcaattcgtatactaatgaagtgcttaattcaatacacggttcaaatatgacaaaaggacaaaatgtaaaagacatgatgacagcaatgaatcccccacgtacctttgatgacagtttctatctttatggagatgctgcaaagaaaaaaatatcgttagacgatactgaaaaggccaaatcagaccccctttttagaaagaaatcatcaggaatcaacaataatgtaaacgtcaatatcgatttttcaagattcggacaatatgctttattctacataactccgcattttgactccaattatagcagattaacgcaaaagtcaatgaaggctgcccatggaacacgtcgtacaataatccaaggatattctcgcccattagctttctattctcctgtctacaaagacaaaataccgactgcaaatgtcaaccatcgtcgccgtacactttattggaatcctactatacaaactgacaaaaatggtaaaattagcatagaatgtcagaacggtatgtatgccaatccggtcattatccacgcagaaatgctgaaaggtggaatcccatgcagtattacgattattggagagaagaaaaaaaaataaaccagtaaatatctccaaagtcccttttaggatttcaatttagatgaaataccgccatttccgacaaattcccctaatgatgtcaagggtcggtcaaggataaaaacaatagtgagacaattggaatacatgaaacagatatttaatgaagaacaaataaataaagctgcattcatcatcgaaagccctttatcaaagctttctgagctttatcatagcgaagttaagaatcttgctattttaatgtcttgaactacaagaaaggattaatatctttttgcgaaactggagaatattctctttacactgattacttcttgaataaacaaatcgaaagaataaaagaaatagaagaataaaaaacagccttcctctcaaaacaccatccttatatcatgatattaaccaaaagctgggaacaaagtgggaacattttggattaagagaaaagaaaaaccctctcagagatcatctgaaagggttttatgaggttcctggcggattcgaaccgccgtacacggttttgcagaccgctgactaagccactcatccaaggaaccattttttctcgtttgcggttgcaaaggtagtacaaattttgaaactaccaactatccgcagcaatttttctttgtactttttttctttacaccgcactcttgacgtttcttctccatcatatcctttaaatcacagccacttacgcagctatcacaaggattctcactttctcgcgtacgacgaaaaaaaagataaattccatatattacacgggcaatgcagagtacaatcagtactccgactacccattcctgccaattattcatacaaacattcctccaatctgataaactgaaaatgccaccagccaggccagccctgtggtatagcaagctgcaaagagcgcccacttccaactgccggactcttgcttaatagccgccaatgccgcaatacaagggaagtaaatcagcacaaacagcatataacagaacgccactaaaggagttatcggaatccgttccgccaggctagcctcatcggcctccggatcatccacatacaaaacacccagcgtactaacgaccagctcttttgcccctactccggaaatcaaaccgatacccaacttccagtcaaagcccatcggctttatcaccggctctatagcccgtcctaactgaccgatataagaattttcctgttgttcagctactgtctcatacgcctcatggttcggataatatccgaggaaccagatgataatagaagcaatcataataatccctcccatttttttcagatactgcgctcccttctcccatgtatgacggaatatggattttgccgtcggcattcgataaggaggaagctccatcacaaaaggagtatcatcaccctttaccaaaaacttgctgaacagacgcgccaacagcacagccagaaaaattccgatcgcataaatacttaacaacaccaaactcgcattgttcgggaagaaagctcctaccaacaaaagataaatgggcagacgcgcgctacaagacatcaacgggttaatcaacatcgtaatcaaacggcttttccggttctcaatagtacgggaagccatgatagcaggcacattacaaccgaatcccataatcaacggaataaacgattttccatgcaagcccatcttatgcataattttatccattataaacgctgcacgggccatataaccggagtcttccatcagcgaaatacagaaatacagaatcagaatattgggcagaaagacgataacaccacctacaccgcctacgataccgtcaaccagcatatccttcaacggcccctccgacatgttattgcgaatcaagtcaccgatttgccccaccagccattcaattcccatcatcggatattctccgagaacaaatgttccctcaaacatcaggtacatgaaaaggaaaaagataggatacccccagatacgatgagtaacgatagcatccagcaccttcgtcgtctgcgcctgctccagatgattgtcagtaaatgtctctttcagcgcaccactgataaaaccgtatttggcatccgttatggcggattcgcaatcctcgttcatcgtttcctgaacgcgcttggccatcttgtcgcgaatacggaaaatctctcccgcattgggcagcgtccgtacaaagctctctatatcgggatcgttttccagcaacttgatagacagaaagcgggtagaatatttatggcggataaattcattcttggatacttcctcttttacagcgtcaatcgctttttccagatcgggaccatgattgatatggatatgacggaatacacgccctttccttttatgttcgcgcacgtaatcctccagatgttcttcctcatgattcttccggtcttccagagaatcatgccattcggtcaggtctttcagaacttccggattcatatttccctgcttgtcaaaaaaatcaaccccttcataaaggttgattactacatgaaacaaggtatccagtccacgattcttcttgctgacagtaggcaccatcggcactccgaacaatttactcaacaaatgataatccaatgtattaccgctggattcaagttcatcgtaaatattcaaagctaccaccatacggacattcatatcaatcagttgggtagtcagatacagatttcgctccagatttgaagaatcgactacattgatgattacgtccggcgtttcatcaacaatgtgacggcggacataaatttcttccggtgtataagctgacagtgaatacgttcccggcaaatcgacaatacggaaatgataaccttcgaaatcgaaatatccttctttggcatctaccgtcacaccgctatagtttcctacatgctcatgagcgccggaagccagattgaaaagagaagttttgcctgagttcggattcccgaccagagcaacgttgatagtacggcgcttacctaacgccaaccgtttcatatcttcttcttttacagaaacatcttcgggcagaccttcgtgatatacagctttttcggcttgtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttacctttgataaaacccatctccacaatacgtttacgaaagcctccgtgtcccaagaccttaacgatgacacctttttcacctgttcctaattcggataaacgcataactatctaaattttcggcaaagataattcataacttccgagcacgcaaattatttagaatgtttttaaatagcaggattttcgtatgctgacggtatctaaataaacccatcaaaagttcaagtcacaacaggtaactaattccctgcctacatctattgagtttacatgcaacaattagttcgtaccactatagtggtacgcaagaagtactatagttccccttacgccctactatagtggcacgcaagaggaactatagtagaacgaattagaaatcgctaaagaaaaaattaatttatgggagttttttccttagccagtccgataaaaacaattagcattcacttgagatacctcaataaactattatctttgcagatatgatacaacaacgggttatacgatatatagagaaagagcatttattcttgccggatgataaacttttggttgccctgagtggtggagccgactcagttgccttgctgcgtgtactccacacagcaggttatcaatgtgaagctgcccactgcaatttccatttacgtggtgaagaatcaaaccgtgacgaacggtttgtccggcaactttgccaaaaatacggcatccgcctgcatatcaccgacttcaacacgactcagtacgcaacagaaaaacggatctcgatagaaatggcagccagagaactccgttacaactggttcgaaaagataaaagaagagtgcggagcccatgtaatcgccgtagctcaccaccaggacgacagtgtagaaacgatgctgttcaacctcattcggggtacaggcattaccggtttattaggaatccgcccccgaaacggagcaatcgtacgtccgctgctctgcatcaaccgggaagaaatcatccgctacctgcaacagatcggacaagacttcgtaacagacagcaccaatctggaagacgaatatacccgtaataaaatccgcctcaacctgcttccactaatgcaggaaataaatccgtcggtcaaaaacagtctgatagaaacaagcaatcacctgaatgatgtagctactatatataataaggtaatagacgaagccaaaacacggattatcactccggaaggtatccgaatcgatgctctactggacgaacccgctcccgaagctttcttgtttgaaacattgcatccactgggattcaattcggcacaaatcaaagatatagccaattcgcttcacgggcagccggggaaacaattcgtcagcaaagaatggagagtcattaaagaccggaatttgctgctactggaaaccatccggccggaagacgaatctacccttccctatcaattaataaaagaggaaagagaattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaataagcgattatctgaccgaccgcaaattctccatcagccaaaaagaacgccaatgggttctctgctgcggtgaacgcattgcatggctgataggcgaacggacagataaccgcttccggatagacgaaacgactaaacgagtgattatctacaagatagtctgaggcaatttctgtttcttgaaacactcggacagcaaagaagcgaaaggagtatcatatttccttgccttgtttgcacatgctttcacacaggcgcagcatttgatgcatttttcagcattcgtgttcagttcgtcccctttggtaatcgctcctgccggacaacgagccgcacagatgccacaatgagtacacaagctctcatcttctatccaaggggtacggggaagcggagttccgcttttacgcagtttgaccaccttcctcaaaaagcggaacaaggggaagaacggctgactgggacgtttgatggcacgcacatccacctgataaagggtatcggatccggcagctgcctgaattttctccattattttttttccgaaatcttctgcataatccaaatccgattcattcgggcgaccgtccgcaatgggacatttgtcagtgctatatgaatgttcacctatgaaggttgctccggcaatcaccttcaatccgtgagggatggcaaaagcgtccagttccatcaacgccttctcgtaggcacggtttccgtaaaccacgaccaatacggcaggagtatccagaccacgaatactttccagacgttccatagccaaaggagccacatggcctccatatacaggcactacgataacagctaatgcagacgtaggaataacggtttcctcgacagtctgcaatgtgagatttatcgaaatgacattttttataccggttccgtgaacaattgcttcggctacttgttttgatgtgtgtgtaggcgaaaaataaattaaacgagcttcatttactgtcatactattttcttttatacagcaaagatacgtttttacgctgaaaaaagtgtttgattgttcatgaaaccaaaaatatttattatctttgccccgttgaaacattctacgattcaacacatacatccctaattcataattaaaaacaaaacatatgctcgcatatctgcggttattacgctgtagtaatgctgtccatatttcatcaagacagaaattttaataacttaccatactatatgtataacattatccaattgaacgacaaaaatctgtcggaacttcaagttattgccaaagagctaggcatcaaaaaagcagactcatttaagaaagaagaacttgtatacaagattcttgatgagcaagccatagccggagccactaagaaagttgccgcagagaaattaaaagaagaacgcaaaggagataaaaacaagcgttcgcgcacagccgcacctaaaaaagaagagaaagtagcacctgcagccaaaaatgcggaagttactaaaaataaagaaaatgctcctgcagccaaacctcagcaacagcctaaagaagaggctgccaacaaagccaaagaagctcccgttgctgaaccgaaggcagagaaagctgctcctaagcgcaaagtaggccgtccccgcaaagacgccaatatcgctgaaaaagcagaaaacaaggaggtggaaaacgcaaaaccgatagtgaaaccaacagaagaaaaagctgttgcggaaaaaacggtagttgcaccggcggctgaaaaagcaactccgacacaggagacagaaaagaaagtaaaagaaaacaaacctgccgttgcagaaaaaccggtaatagccaaaccgcaaaagaaatcggcaccggtgatcgacgaagaaagtaccatcttatccagcgaagacgatgatgactttatcccaatcgaagacctgccttctgaaaaaatagagcttccgaccgaactcttcggcaaattcgaagcgaccaaggcagaaacagcacaagccgcccccgagcaagctccacaaccacagcaacaacagcattcacaaccgcaacaacgccagcgcattgtccgcccacgcgacaacaataacaacgccggcaataacaatgtaaatgctaacaacaataataatttccagcgtaataataacaacaaccagcgtcctccgatgcaacaacgtcctgcacaacagcagaacaacgttgccgagaaccttccggctgtacaacaacagccggaacgcaaagtgatcgagcgtgaaaagccttatgaattcgatgatatcctcagcggagtaggcgtactggaaatcatgcaggacggatacggattcctccgttcttccgattacaattatctttcttctccggacgatatttatgtatcacagtcacaaattaagttatttggtcttaagaccggtgacgtggtagaaggcatcatccgtccgccaaaggaaggagaaaaatatttcccgttagtaaaggtgtcaaagatcaacggacgtgacgcagctttcgttcgcgaccgtgttcctttcgaacacttgactccgctcttcccggacgagaaattcagactctgcaaaggcggttattcagactccatgtctgcccgggttgtagaccttttcgctcctatcggtaagggacagcgtgcactgatcgtagcacagccgaagacaggtaagaccatcttgatgaaagatatcgccaacgccatcgcagccaatcatccggaagtatatatgattatgctgctgatcgacgaacgtccggaggaagtaaccgacatggcacgcagcgtcaacgcagaagtaatcgcttctacttttgacgaaccggcagaacgccacgtaaaaatcgcaggtatcgtactcgagaaagcaaaaagactggtagaatgcggacacgacgtagtgatcttccttgactctatcactcgtctggcacgtgcttacaatactgtatctcccgcatccggtaaagtactttccggtggtgtggacgccaatgcacttcacaagcccaaacgcttcttcggtgctgcccgtaacatcgaaaacggcggttcgctgactatcatcgctaccgcactgatcgacaccggttccaaaatggacgaagttatcttcgaagaattcaaaggtacaggtaacatggagttgcagcttgaccgcaacctgtccaacaagcgtatcttccctgctgtcaacatcaccgcatccagtactcgtcgcgacgatctgctgcttgacaagacaacactcgaccgcatgtggatattacgcaaataccttgcagatatgaatcctatcgaagcaatggatttcgtaaaagaccgtctggaaaaaacaagagacaacgacgaattcctgatgagcatgaatagctgatcaagaataaacgatcataaataaggaacggtgaatatactggacgatgaataatcgcagtttattcaccgttctttttatgatttccattaattcttttcatttattattcatcgcggtcttcgctgttcctcatgaatcgttcatcgcatatttcatttttgtacaaattactttcatttacgtccaaaaccactcccccgcccttttttgctttttgttttttcctacttttgctacccaatcaattacttaattctagccaagaatgaaaacaatttatccattcatgggattagccctttgtggcgcagcagcccaggcacaagaaaagccgaacttcctgattatccagtgcgaccatctcacacaacgtgtcgtaggcgcttacggacagacacaaggctgcacacttcccattgacgaagtagcatcaagaggagttatcttctctaacgcttatgtaggctgccccctcagccaaccttcacgcgcagcattatggagcggcatgatgcctcaccagaccaatgtacgttcaaactccagcgaacccgtcaacacccgcctgccggaaaacgtgccgacactgggtagtctcttctccgaaagcggttatgaggccgtacacttcggcaagactcacgacatgggctcactgagaggcttcaaacataaagaaccggtagccaagccattcaccgatcccgaatttccggtcaacaatgacagtttcctggatgtaggaacctgcgaggatgccgttgcctacctcagcaatcctccgaaagaaccttttatttgcattgcagattttcagaacccgcataatatctgcggattcatcggcgaaaacgcaggagtacacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgaagaaaactatcgtcactacatcgccgccttccagcattacaccaagatggtgtccaagcaagtagacagcgtactgaaagccctctactccacccctgccggaagaaacacgattgtcgtaattatggcggaccacggcgacggcatggcatcccaccgcatggtgaccaagcatatcagcttctatgatgaaatgaccaacgttccgtttatctttgccggtcccggcatcaagcagcagaagaaacccgtagaccacctgctgacacagccgaccttagacctcctgcccaccctttgcgacctggcaggcatcgccgttccggcagaaaaagccggcatcagccttgcaccgactctaaggggagagaaacaaaagaaaagccacccttacgttgtctccgaatggcacagcgaatatgagtacgttaccactcccggacgcatggtgcgcggaccgagatataaatacacccattatctggaaggcaacggagaagaactgtacgatatgaaaaaagatccgggtgaaagaaaaaatcttgccaaagaccctaaatactccaaaatactcgccgagcatcgtgctttgctggacgattacatcacacgttccaaagatgattaccgcagtttgaaggtagatgccgatccccggtgcagaaatcatactcccggctaccccagccacgaaggtcctggggcacgggagatcctcaaaagaaaataattctataaaaaagagtgaagattgcttgccagtcttcgctctttttatttcttttgcacatcaccatacgagcaaacaaaatagtgaatagtaatttacagcatataatagcactcattgcagccatattcatatcggcggctctccatgcaacaaacctgaacaaagaacgacttaccttactccagccacttgtcgagcatgatctttctttcaatacaaatatcgatattacaacggacagcatcatcttatgggaaaagctcttaagccccgaacttgaaaagcagcaagaatatcatattctgtttccattgaaaatgatggcagttcaggcattaattacagaaggaaatatcagtctggcagtcaacaacgccaactcaatgtatcagcaagccaaagctatagattatcctttcggaacggcactggcattgcgtgcccttgcagacacctaccaaagttcgggaaatccccagtctgctatagagtcttatgaggaatccttgaaaataatgcaaaaaattccggcaagtattccatatcttaagacaagcatgtttcatttgatcctgagcaaactcaaatacaggcaaatgacagatatcgaaaaagattttgcctatctggagtctctttaccataaagaatcaggtttgcccgatgacttctatctgccttgcagctatgcctattattatatacagacaaacaaccttccaaaagcactggagtatctgaaacagctggactccatctacgaaaaatatccgtatccctactattcttcaatcagcaactatatgtatgccggctatcatattgagtcaaaagaatatgataaagcgctgaaagaatatgaagaattactcaccataacaaagaaaacggctttattcagacatgttcagttattacaggaacgcgccaaagtcctggtacttatgaatcagaaacaagaggcgtgcaagatttatgaggagattaatcatctcaaagattcattggacgcccaaagttatctcagccagataaacgaactgcataccctgtatcagatagataaaagcgaacttaattatatcaacatacaaaaaaatctctattattggagtctgtctgtgatcttagtgatcgtagtactgatcatcattgccattttccgcatcaagcgcaccaacaatcgtcttctgcaatcacaacaggaacaggaaaaagccaagaaacaagcagaaaagtctatccacaccaaaagcctttttctctccaatatgagccatgagattcgtactccgctcaatgctttatctggtttttcagctattctgacagaagaatccatcgacaacgaaacgaaacaacagtgcaacgatatcatccagcagaactcagaactgctgctcaaactgattaatgatgtaattgacttatccagccttgaaattggaaaaatgcaattcaaattcaacgagtgtgatattgtagcgctatgcagaaatgtcatcgacatggtagagaaaataaagcagactcaagcggaagtacggttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagatacggcccttttctccgttagtgataccggttgcggaatctccaaggagaaccagaacaagatattcaaccgcttcgaaaagctcgatgaaaacgcacaaggcacaggactcggattatctatctgccagcttatcattgagcaactgggaggcaaaatatggatcgacccggactatgacaaaggagcacgttttctgttcacacacccgattcgccatgcgcagataaaaaaggaggaagcacgatgaaacgactgatattactgatcatcacctgctatggcctgctgttgggctatgcaaacaccgatactgcctcagacagtctgctgcaaatgttgcagacactgccgcatgataccacacgcctctctacactgaatgcaatcataaaaatagagcaaaacaactacaaatgtatccaatattcggacacgttgatgctagaggcattaaaactaaagaatgataagtacgccagtctggccgcctactatcatcttttgtattattacaaccgttgcgaacaggacagtgtagccaaatggatagtcaagatggaaccgcttgtacaaaaatccggtttatgggactatttcttcgacgcccgacgctttcagattgacctatacacctttaccgaacaatatgagcttgccatcagcgaagcaaacaagatgaaacagaaagcccttgatatcgacaacaaccgtggaatggtagccgcttatcaatgcctgtccaacgcatacatcggcagccagcgctgggacgaaggactcaaagcgctggaagaagcctacaggttgcttccaaagaatggcaatgcggtagtccgtatctccgtcttgtcacagctcatatccgttaccaaagaaatgaaagacaataacaggcaactgaaatacctgcaagaactggaaaatgtactctgcaaattcatcattgacaacccatctttaaaagacggatttgccgacgtattcattttcaatgagattttctacgcgcattattatctgaataccgatcagccccaactcgcttattcacatatagaaaagtctaaaaagtatctgactgaaaacacctatttcatgtataaggtgctctactacgacatctatgcgaaatactatcagagtatcaaacaatatcagcaggcatcagcctacatcgacacgacattaactatgctcaagaaagatttcaccagcgactatgccgaacaattgctgaaacaggctaaaatatgggtggaagccggagataataacagagcgacaactctctaccaacaggcactggccatcaaggactcggctgccatggcactctccaacacccaaatggagcaaatcaaaaaaagctataatctggacaagatagaactggaacaacaaaagcagaccaaccaaatacgtctgatcagcctgatcgtaatcagtgccattctgatcgtattatttatttccctattccggctctccaaaatacgcaaagccctgaaatattccgagagcgaaatacgcaaagcagcggaaacggtacgggtaaccaacgaaataaaaaatcgcttcctgtcaaacatgagttataacatccggaccccgctcaacaacgtggtaggtttctcgcaactcatagccagcgaaccgaatatagatgaaaaaacaagagaagaatactcggcgatcatccaccaaagctcagaaagattaatgagactggtcaatgatgtactcgacctgtctcgtctagaagccaaaatgatgaagttccagatacaagactatgatgctgtctcactttgcaacgaagtatgctacatggcacgcatgaataatgaaaagacaggcattcaagtccgcttcactccggaagtcgagtcactgtcccttcgcacagataccacccgattgggatacgctctgctcagtaccctgacctatccgcatgaacatgaaacagagggacaacaggaggaacggattatccgctttacattaagccggaaaggcgaaatgctttatttccgcattctcaactctccattggcggacgaggctttcacctcacaggagaccggcatcaggcatgagatcaaccagttattgctggcttacttcggaggaagctatcaggtaaacgcccggggaacggaaggcccggaaattgttttcacctatcccattgcttcagaatcggaataaagcgctatctttgcaaactgtaaacttaaacgcttaattatgtataccaacaaacagatttggagtgtcagttacccgatactactcagcttgctggcgcaaaatgtcatcaatgtcaccgataccgcattcttagggcacgttagtgaagtggccctgggagcttcggctatgggtggactattttatatatgtatattcaccatcgctttcggattcagcacaggatcacaaattgtcattgcacgacgcaatggagaaggacgctacagtgatgtaggtcccgtaatgattcaggggattatgttcctcctgttgatagctatattgatgttcggcttcaccaaagcgttcggaggaaatatcatgcggttgctggtttcttccgaatccatctacgaaggcactatggagtttctggactggcgtatttacgggttcttcttctcgtttgtcaatgtcatgttccgtgccctgtacatcggcatcacacgtaccaaggtcttgaccatcaatgctgttgtcatggcattaaccaacgtcatattggactatgcactgattttcggtaaattcggtctgccggaaatgggaatcaagggagctgccatcgcttctgtactggcggaagcctcttccattctcttcttcctgatctatacatatatcagtgttgatttgaaaaagtatggtctgaatcgtctgcgctcgttcgatccggcattgctgatgcgtattctcagcatttcttgcttcacgatgcttcaatatttcttatcgatggcgacctggttcgtgttctttgttgccgtagaacggttgggacaacgggaactggccattgccaacattgtccgtagtatctacgtcgtactgctgattccggtgaatgcactggcaacaacgaccaacagccttgtcagcaatgccatcggcgcaggaggtatccaatacgtcatgccgcttatcaataaaatagcccgattctcgttcttcatcatgctgggactggtgggattgtcggttttgtttcctcagttcctcctctccgtatataccagcgaagcagcgttaatcaccgagtccgtgccttcggtatacgttatctgctgcgccatgctcattgcatcagtagccaatgtcgtattcaacggcatctccggaacaggaaatacgcaggcagccctgttgctcgaaaccatcacgattgccatttacggttcctacatcgttttcgtcggaatgtggctcaaagcaccgattgaaatctgctttacgattgagattctgtactataccttgctgttgataacaagctatatttacctcaaaaaagcaaaatggcagaataaaaagatataaatacaagagatttttgtacatttgcaggctcaaataattaattcgtaattaaacaactatgttcgataatttaagtgaaagactagaacggtcattcaagattctgaaaggtgaaggcaaaatcaccgaaattaacgtggcggagacgctgaaagatgtacgtaaggcattgcttgatgccgacgttaactacaaggttgcaaaaactttcactgacacggtgaaggaaaaagccatcggtcagaatgtacttacggctgtgaagccaagccagttgatggtgaagattgtgcacgacgaactaacccagttgatgggtggcgagacggtagaaatcaacctcgaatcccgtccggcagtaatcttgatgtcaggtctgcaaggttcgggtaagactactttctccggtaagttggcacgcatgctgaaaacgaagaagaatcgcaaaccattattggtagcctgtgacgtttaccgtccggcagctatcgaacagttgcgtgtactggcagaacaaattgaagtgccgatgtactcagaactggacagcaaaaatccggtagagattgcacaacacgccattcaggaagccaaagccaaaggatatgacctcgtaatcgtcgatacagccggacgtctggccgtagacgaacagatgatgaacgagatcaccgctatcaaagaagcgatcaatccggacgaaattctgttcgtggtagactccatgacaggacaggatgccgtcaatacagccaaagaatttaacgaacgtctggacttcaacggtgtggtactgaccaaattggatggtgacacccgtggtggtgcggctctttctatccgttcggtagtcaacaaaccgattaagtttgtgggtacaggtgaaaagctggatgctatcgaccagttccacccggcacgtatggcagaccgtatcctcggcatgggtgacatcgtttcgctggtagaacgtgctcaggaacagtatgacgaagaagaagccaaacgtctgcaaaagaagattgccaagaatcagttcgacttcaacgacttcctcagccagattgcccagatcaagaagatgggtaatctgaaagaacttgcatccatgatcccgggcgtaggcaaagctatcaaagatatcgatatcgatgacaatgctttcaaaagcatcgaagctatcatctattccatgactccggcagaacgttccaatccggaaatattgaacggctcacgccgtacacgtatcgctaaaggtagcggaacaacgattcaggaagtaaaccgtttgctgaaacagttcgaccagacccgcaaaatgatgaagatggtaaccagcagcaaaatgggcaagatgatgccgaaaatgaaaaaataaaaagaattttattctgtttcagatagaaggaggtgtgtcaaaagtcaaaagtaactaaactcccctccttcaggaagctaccctttatacacaagtcttagctgattaactcatacagttcaaactgtgtattaaatctatccagtccattcttaaaggttatatatcctggaatggactggctcttgtatgcactccatgctcctaaccttgcaataatccatgctgcccatgccattgattcttttttatatggattttgctgtatttttgtatttccctcactctcctctcacttttgtgggtgaagatgatgaaaaataatataaaacgaggaaatgtgttgtatagttgaacaacatttcttatatttgcgttatgaaaagagaaataatagcatataaaggatacttcaaagaattctttgaaaatttagatgctggcacccaagataagatattgtatgtgctaatgttattgcagacacaagacagaatacctttgaaatttatgcggttgatagaagaaggactttatgaacttcgtatcgagtaccaaagcaatatatatagaatattcttttgtttcgacgaagggcgtattgtgattctgtttaacggttttcaaaagaaaaccgaaaaaacaccaaagaaagaaattgataaagcaaagatattaagaaaggagtattatggaagcaaaaacaaatgaggaattctttaatgtcagtgcattaatagatgagcgttttggtaaggaaggaacagcttctcgtgcagaggcagaagaaaaggcctacgccttttatacaggacagattatcgaggacgcaagaaaaaaggctaaaatcactcaggctgaattagcccggcgtatcggctctgaccgttcttatatttcaagagtagaaagtggtcagacagagcctaaagtatctactttctatcgtataatgaatgcgttaggctgtaaaatcgaattttcaatgattttgtaaaaacaataaatgcagagtatctgtcaagatgactctgcattttgctatattcacaaggctttcccgcttctattcatacagcctgtttgattttacctgctcgatatctataataaatacggcatatcggcgcccgttatttccttttttagattcaaaatggtgcttagtcatcaccttccccaactgtatttttgatccgatggaatactgataaccggtacgctcacgtattagttccgcaatctcactgacagtcagataataaaccttctcaaaacgttccggcttgcggatatgcgtaagaaccatttcttcttccggtgaatgaaagatgaaagcctcgttattctcttcaagccgttcattgtccgcttgcgtgaaccagtattggtaccccggcttattcagcagatatttgatctgagcatagagctgcgcataattgatggtaataaattggatggaataaggatgaaaacaaaggaaacgccggttgcctgtcgtgtcgtgaagcacttcctgataattgcaggttcctgcaaaagaggccgtatgagggaagttttgcgaacggcgtgcatatggcagacggaaactgatcactttgcgcgttaccaaatctttgaatgcattcagttcccgaccgctcatcccttcaaactcgtcgagattgatcagcatggcctgcgttattttggctaaatcatctttattgttcgaattgattagtccggtagagagataagcacgcagttcgggaggcaggagattattgataaaggtagtctttcctatgttctgtatctcgctgcatagcagaagtaccgtgtgattgacaatattctcctgagtagccgctgcgcacatcgccaccagataacgttccaggcattccgcccaaaactcctgatgactcgtctggacactatccgccaggatacggatatagtcggttccgtcccattcgggcagtaattcaaaatactcgcgaatgggatgatacgactggctgaaatcggagtaaatcagattttcgattgttttgacagtgcagggatatcccagctcgttgatttctatccagatactgttttccatcatctcatccaagatgcggaaaggctccggtttctcggtgtcgggacgccttctgcgatattccatgatatgcagcacttcattgtagcgtgtttcgtagtgctcgctgatatattgttctatccgtaatattcgtttctgcgtgccattcagtttacaggtattaaattcgtcggtatgagcgtaggcgctattgatcaaagagactgtctcgtccgccggaaagtctgtaaactggcttttgataaaggcggatgtttcctcctgcggaatgccgtagcgattgaaggtacatgagagatggtgcagataattgttccggttgcctgctatgtatttttcggacttgttgtgatagtaagttaaagtcaacaccaaagaagcgttggcggaatgggcgttgagtgctgtgtcttcattcgtcggggtgccgtccggaggagtctgttgtttactgccggagagatttttacgatttgaaatcttgtaggatgcctgaggttgatctacaagaaaagcgtcagcgttcggattgaaatagatctccggatcgtaagagaacagacaagtgcgtgccacatcctgaccggaggtgtcgatttctatccgacagagttcggtgtaaaaagaaacgagtctggtgtaagctgcatgatggaagtcttctatttcctgaagggtttcgggcaatgtctcatccggatggcatgcgcgcactatgattttcacgcccatccctttgggactgataaaggcgatgcgggtgtaatcgcatctcttgatgatagggaggatgcgtgccaattcttctttgctgaggtggtcgatgtctatcacgatgtgtcccagatatttgacgaggttcactttggtacgccttcctcggtagctggcggagaaggcgattgccggcaattcttttttcttctcattggcagccttttctccttgctctgcaaagatgcggcgtatttcttcgactttttcccggtaggtaaaactgccgatagtggacactatttcttcttcggtcatctctgctattgcgtagtagaaaccttgaaatatggtgaaatgtttcatttttattttgattattgtttgtcgatgcaaaggaacttctttgcggaaatgtgtaaaggaactttgtataaaatggcaataagttactacggttcgcccaaaaagtgtatgatagttgccacttgtttcggcgaaaggagacggttgcgtgcgcggtagccttcctgttcgagttcgtgcaggagagggaggttgtaaataatccaacgacgaagtatttgtaaagcaactttgaggcagacatggggattgtaaaggtgagccagttccgctttggtataggtgcggataaggaaagaatcttctttgtaattcatgatgttttcttcttgttttatgctataaagttacataaaattccttgtttttcaaaggtttgacttcatttttattcgttgggaatcaagaaacttcgttggggaatatggcttgtccggctatccttatctttgtgctgttaacaagaaagggatgcatcctacgtattataaactttaaaattattttattatggcaatgacagtatcttattcagtggtgccgcgcaagaatcctgcaaaaaagagtgaaccggcaaagtattatgcacaggcgcaggcgtcgggtgagctggactttgaagagttgtgcgaagcgatcaccagtcgttctacttgtacggaaacggatgtacgtgcggctatttcgggtattctttacgaagtgaagcgtgcgttgaaggcaggaagaattgcgagactgggtgatttgggcagtttgcagataggactgaacagtgaaggtgcggcatcggtcaaggaattttccggttcgatgattaagggggcgcatcttattttccgccccggtaaaacgctggcggaattgatgaagattctgagttaccagcaagtgctgactcgtgcggtggcgcaggcgggtgcaggcgatggcgggggagaagaccctgacaagaatccggattccggtggtgatggctccggtgatgaagaggctccggaccctacggtataattggcagacgggtcaaggtaataacgaattagaataacttccattaatattttgataagatgaaagaaatagtaaaccggattttagatgtgatcatgtatctgattcctttcttcggaaagagaaagcgggacaaggtggtgagagaagtgcgctatcatactacttgtaaggaggtgtgcaaagtgaaaacgacggaaagggaaaaggaacatgagaaagattagtctgattgtgatccattgttccgccacccgtgtcgattgcgactttacggcaaaggatgtggatacggctcaccgttatcgtggcttttcgtgctgggggtatcattattatatacgcaagtcgggcgagattgagccgatgcgggatgaagatacggtcggagctcatgcacgtggctacaatgcgatcagcttaggtgtatgctatgagggcggtctggatgagaatggaaaagcggcggatacgcgtacaccccgtcagaaggaggcgctacatcgcttggtacacgaattgttgcagcgttatccggaagctaaagtagtagggcatcgggatttaagtcccgacaccaactataatgggatcgtagatccttgggaacggattaaagaatgcccttgctttgaggtcattggagaattctccattaattaactactaccgtagtgaaatactctttgaatacctccgcagctttttcaagctgttcgggggtattttcttttacccctttcatcttgtattcctgtcccatcgcttcgtacttatgtacgcccagtgtatggtaaggcagtatttccacccgttggatcatcttgtattttccgagtgcttctcccagtgcgcgtatgtcttcttcaaaatcgctgtatccgggcactagcacataacgcagccagaaaggttttccctgttcttccagccaggcggccgtgcggatggtttgctcgttgcttcttccggtgagcgtctgatggcggttgggattgaattcctttatatccaataacacaagatcggtcagcttgaataattcttctacgtcttcgttccaaagtcctccgttgctgtccagacagacatggatgcctctttctttcagttcgcggaccagcgggacgagtgctttcgcctgaaacgtcggttcgcctccagagaaagtgattcctcctcgtttcccgaagaaggggcgctggctcattgccatgcggacgatttcttccggtggggtaggcgtgcctccctttcctgctatcgtatccggattggcgcaatagaggcagcggaagttgcatccttgaagaaaaacgacgagccgtaagcccggcccgtcgaatgttcccatactttcgtatgaatgtacgtttatcatcatatagagtaatagattacatacgttcgtggaagctacggctgataacttccagttggtgttcgcggctcaacttcacgaagtttacggcataaccggaaacgcggatggtcagctgcggatagttctccggatgctccatggcatcgtatagcatatcacggttcagtacgtttacgttcaggtggtgggcacctttggtgaagtaaccgtccatcatcgttacgaggttctcgatacggtcttcgtccgtagcacccagtgatttcggaacgatagagaaggtgttgctgataccgtcctgtgagtcacggtaacgaagtttcgctacagagctcagagaagcgatcgcaccattcttgtcgcgtccgtgcatcgggttggcacccggagcgaaggcaacacctttggcacgtccgtcgggagtagcaccggtctttttgccgtacatcacattggaagtgatagtcagcaaggagagggtaggacgggcattcttgtaaacaggcaatttcttcaattcttcgctgaagaagtataccaggtctacgccaaggtggtctaccttgtcgttgtcgttaccgaagcaagggaattctccttcgatgtcgaagccttctgtcagaccgatatcgttgcggcgggcagttactttcgcatatttgatggcagacagtgaatcgagtgcgatggaaagtccggctacaccgtaagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtccattacttcttcgaacttcagcgtgtcactggtcagtacggggatgttcttcaccatgactgtaccggtattctcgcaacgtccgccgttgatggcaagcaacagggctttggccaggttgcaacgggcaccgaagaactgaatctgcttgcctatttcctggtatgatacgcagcaggcgattccgtagtcgtcggactgacgtacttcacgcatcaggtcgtcgttttcgtactggatagaagaagtgtcgatagaaacctttgcacagaattctttgaatccttcgggaagttccgggctccagagtacggtcaggttcggttccggtgaagggccgaggttgtacaatgtctgcaggaaacggaaggaggtctttgtcactttggtacgtccgtcgttgagacgtccgcccagagattcggttacccaggtcgggtcgcctgcaaagatgtcgttgtatgattgcatacgcaggtggcggaccatacgcagtttgatgacaaactggtcgatcagctcttgcgcgaacgattcggtgatggttcctttgctcagttcatattccagatagatatcgaggaaagaagaaacgttacccagtgacatggcggcaccgtcttgttctttgacggcggcaaggtaagccatatatacccactgtacggcttcttgtgccgtgtaagcgggacggctcaggtcgagaccgtagtattcgcccatcactttcatgtctttcagtgccttgatctgttctgccacttcttcgcgcagacggatacgggcatctgtcatcggaccggtgaggttgtgcaaatcttccttctttgcttcgatcagacggtcgatgccgtaaagagccatacggcggtagtcaccgatgatgcgtccgcgtgcatagttgtcgggaagtccggtaaggaatcccagcgaacggaaggaacggatttcttccgtatatacgtcgaatactccgtcgttgtgcgtcttgcggtagtgagtgaaaatatcttttacgcggtcgtccacttccacgccgttttcgtgacaggctttgctgactacgttgatacctccgaaaggcttgatggcacgtttcagaagttcgtctgtctgcaggccgacgatcagttcgttttccttgtcgatatatccggccttgtgggaagtgatggttgatacggtaacattatctaatgagcggacaccgttgttttctctttcttctgccaacgcttcgaggcagcggttccatacggctttggtacgttctgtaggtccttcgaggaatgaagcatctccgtaatacggagtgatgttatgacttacgaaatctctgacgttgatttcgctgctccaaagaccgtctttaaagatcttgtttaattccataaaatgataaaattagaggttgtagttatcctattctttagagcgcacaaagttacaatcatttttcatataatcagcataaatatgctctattttatgcttttcaacataaaatacctattaattgctatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaaaatatcttcgtacctttgcaccgcttttaacgaaaagcacttctgataaggaagttttggagaggtggcagagtggtcgattgcggcggtcttgaaaaccgttgtaccgcgaggtacccggggttcgaatccctgtctctccgctggaaagaattgaaaaacaaagaaaatccctgtaaattaatactttacggggattttttgtttttggtacatagcaaaaataagcatatcaaagcattctttcggtgtactattcggtgtacctgattgccttcaatgccaggtacacctattaagtaaataattcattgtttatcagtgctttgcatcttgacttgttgctcttggaaatttagttttgtgattaaaaaacaagtaagatggaaagaacaacattttgtctattgttctacattcgtaggacgaaattgaatcggaacggtgaggctccgataatgatgagaattacagtgaatggagtccgggttgatgcttcagtgaagaaaacaattcttccggagttctggagtgcggcaaaaggaaaggccctggaaaagaagcgtgagtacaaggaactgaatctgtatcttgactctatccgtttgaggataatgaagattcaacgtgaactggaaatagaggaggtatccgtttctgccaacagtgttctggatcgtttcctgggtaaggatgcccccgtacaacgtactctgtttgaggttttccgtgagcataatgataaatgtgtccaattgtccggtacggacatggcgcctgcaaccgtgcagcgttatgagacatccttgaagcatacccgggattttgtctgggagacatatcataagaaagatgttcttttggatgaagtttcccgccagtttattgaggattacgagttttggcttaagacagagaaaaagtgttgtcataacacagccaccaaatatttgaagaattttaagaagattatccgtattgctttggctaagggatggatgaagaacgatccgtttttagaaattagattctcattggataaggtggaaccggactttttggaagattcagaaatccagaagctgatatcgaaggaaattgatattccacggttaagtcaggtacgggatatttttgtgttctgttgtttcaccggtttggctttctcggatattcatggtttgagaaaggaacatatcgtggaggactcgaacggtgtcaggtggatacgaaaggggagacagaagaccaaaatcatgtgtaatattccattaatggaaataccattgaagattttggaaaagtattccaccaatgaatattgtaagaaacatggtgtgctttttccggtgctttgtaatcaaaaaatgaatgcatacctcaaggaactggctgatatttgtggtattaaaaaaacattgaccacccatgttgggcgtcatacttttgccacatttgctctggccaatggtgtctcgatagagagcgttgctaagatgttagggcataccaatgtccagatgacccgtcattatgcacgtgtgctggatcgtacagtgatacgtgagatgtcacagataaagatggattttcatatctctatttagaattatctggtaggaggttgaattctaagtcctctccaaacaatatctataaaatcttacccaagtttacgaacattaacgtatccttgggtaagtttgtatatagacatacctactcttcagaagtgtatagctacttcctaaaatatttacctaatatagaaaataggttatcattgaaatggcagtaatcatattgataatagatttgccccctaaatgcgcctaaacagcattttacatatttttcttctcccggtgtttgagtaatgcttaccccgtttttgtttaaagtttccatactactataatttacaatgagttatcagataatcagaagtgaaagcagcacaatgaaaataaacgccatacaaagcaggtaaacggcagagataaacagccggagaacgaaccggataataaaaaagcctataattagggctatccatattccggtggtgctggtggctgcctgatagatgataaaagcaagtatgaaccaccgtaaaaaagtcgttatcttattatatactttcattgtcttggtgtgttgtgggtggattgctccacccggttagtaatcaggcgcaacggaaaacaaaaccattatccatccagtaatcagtcataaacaggtcacgggcaaaagccgaataatcaaagtaggtctttgcgaactccggcaggtcgtaacattcctctacaatttcataggcgtaatcttcctcgtctttatattctccctgatattcatcctcaaaagaagaaataaggtcgtccgcatcttcttcgcttatatcgttgttgtggtggtcgcaccatacgaaaaacgcttcctgctgggtttcacttagtttttcgatggcatcccgaagctcaaagaacttatcggaaagccaactttcggaaatcagggcttccgggatattctcgtaatcctgaaacataaattccgggtcttggtcgtccttgtgcagttcccggcacgcttccataaattcgtccttgtccgaataatcggaaaggtctaaccacttgccgaaaagtgaaccactgttatacttgttgtaagtacctacataaactcttgcttctgataaagttactgtttccatgacttttgaattttaattgtttacatcgcttgtcgcccaccacataaatttttcctttaactgaatgggaacattgtcttttcaaaggttcgggaatggtacagggcaaattattatttatgaaatactacccgtaggtgtggagatttctaaaaaataatttgaacagtaacaggcacggatatacctttgacaatgttccaatcagttttagggaaaatttttctcttgtttaagaggatagaagtaaaagccatcaggctttttgtattgggtaatgagagagtaaaaaaagggcttataaaagcccttcgtctgcaaaactgtaatagctttcttctgttaagatgatatggtctaacaggtgtaaatccaagaccttgcaggcttcatttattttggtagttatttttttatccggttcgctcggacgtagattgcccgatgggtggttatgtgaaaggactatccccgaagcatggacttttaaggcggtttgcaggatgattttcacgtccattactgtttcagccatgccgcctttagagataagggaaatgcctaaagccttgtttgcccgattgaggaacattacataactttcttcgtggtgttccatacattccgcatagaacggtttcagataagtataggacgtttcggatgagagtattttcactctttcggatgcttttacattgtctttataagagatagtgatttccggcatggtaaattctgttgttttcataacacttgaattttaaattaaacaataagaaattttgccggacacccacagtttggcggggacttcaacctaatcttttcaaaaaatacgacccgtaggtgtggagattttttagaaaaccggaacggctcggatttggtatttgtccctgccgggctgtaactttgctaaaatttgtgattgagatacattactttagggaactgaaaaaggggtatcactgatgacaccccttagacaaccgaataccttaaaccgttattcatcataggttctatatcctatcggtttgcgtggctttgggtcaggtttacttagtaattgggtaagtgcttggtaaacctcgctgaattgtgcatccgtactctgttccagttcttcgatgcgtttaagaagttcctcgtaaccgattgacatttgccgcatgaggacgaaagcacgcatgatggaaatattcacgtctatggcagtctgactgcgtaagacactactaagcatggcgacaccctgctccaaaaatgcgagaggcggggtcggtgtgtgccggatattttcagggaacttatcacaatttgtgataagtccctgccattcatcctttgttagctgaaaagcaaagtcactgggaaaacgggataagtttcttttaactgcctgtttcaaagctcttgtttcaacttgataaagttctgccaaatggaaatcgagcatgacccggcaacctctgacctcaaagattttgttttggatgatttgtaagtccataatgttattatttaatggtgagtaattggaagcataaagggacttatcacaaattgtgataagttcccctatatacctatttcatagatacttctttgtagattttttcaatgccgacaaatttcttgtcaagtccctgcatatcgttacttatcttgttattggtaatgcgggcgtatatctgtgtggtttctatgttggtgtgtcccagcatcttactaacagtttcaaccggtacaccttttgcaagagtagttgtcgttgcaaaagtatgccttgcaaggtgaaatgtcaagttctttttaatcccgcaaacatccgcaatttctttcaaatacgcatttaatttctgattgctgattacaggaagtatcttaccatcaggcaaattacctttatacttcttcaatatcattttgggaatatccagcaaaggaacatttacgtccgtgttagttttttgacgtttggtgattatccataaattaccgtcaaaggatttacgaatattatcttgcgtaagattggcaacatctatgtaagccaaaccagtgaagcaggaaaagataaacaagtccctgacgttttccaaccgttcagaaaccatcttctttttaaggatgatttttatttcatcctctgacaagtaacccctatccactttttccaaacgtattttataactggcgaatgggtcgcctatcaaaatgccattattacgggcaatcaggatgatacgtttgaaaaactgcatgaacttggcggtcgtgttataaccacatttacaggtagtacgcaaatataactcgaagtctgtaatgaacatcggtgttatttcatttatcgcaaaatccgatacattatatttgctttggatgaactcggcaagatggcggcgggtcacttcatatttacggtaggtagcaatcgttttagatatgccgaccaactgcttaacatcatcattgtgctttttgaaaagggtaaggacggtttcgtgtttctcactgtgtcccaaaaattcattcttcaccttttcggctgttacataattgtcacgccgttgttgttcgtggtagatattgttcagggatgcttttatatcatctaataaagcattgattttacctgcatccttacctttggcttttcctgctgcgatattccagctatcaggcaaaatgctttgttttgtgctgaactggcaaagtttaccgtcaatggtaattcttgccataatcataacttcaccgttctttttttcagagcctttctttaaatagaaaaggactttaaatgtactcttcataacctcacatttttaagttgcaaaactactaataacttgttaaatgtgagatagatagacggtggacaaattcagactttctgcggtcatttcgggacaaatcgttaccgtttttgtccggtagggaataggtaacgatttagtaacgaaactatgtcttttatagtccttttgttgtcttggaaacaagacttataggcaataaaaaaaacctacaaatcgctgatttgtaggtttttgtccacttactgtcctgttttgtccagtaggttctgcggagagacagggaacgattaactttaaggttccttactcattatcagcatcttacataaatcctcaattcctatgacaccgcataattcaccgcatatatgctgcaactttcttcctgttacacttttacttacttttgcaaatatacgaaaaaagcagtataaatacaaattcatcacttgatttaacgaagataacttctataatttttttccaataccgattgcaatttggaaagaggataaaggaacttgccacctataacagtataagctatccccttttcatcctgcaacttttgcaaagtcctgcttgatatatgtaacatactacatacctgctcaccagtcatataaacctcattagctacaggaacctgcaaattctgaaattcaagaatttcctttgagcattttctaagcatcctcattatcataatatattcttctgattgttttgtaattaccccatccatactctaactctatttatggatattcagtaaatgttcctctttcttctaaattaagaaaaaagttttactttacgtgagcttttctcttgattttttcgttcaattctcccagtcttctatctttttcatagaacattatttacatattcttattttttcttcccacccatgcattatgtacatatcttttttaggggaagttaaaacctctcctcttttcctcttattttagtcagattatgctgcctttcttttttttcttttcgaccttttctatcatacataccgcattggctgtatgtatcccaaagaaaactcaaagtacttccgttttcctgtttctggcttttatcctggccagtgaataatgttgtttctgcgtttcaaaacttccttccaggcgggtagctctttcacggctgagttccgaccgtaagattctccgaaatcgctcatctttggcggctctgcccttacgcttggacaatagggcattaaagggcagatttcccgtatatgcgcctccttattctcgaattatgggcgtaagtcacatggttatgaagagatatctaccctttaatggggagaacagccggctaatatctgatggaaatgcccaacaaatcacaggaaaatagccacgcaatagtctgatacacaataattattggagatacgtggtccgctcctgcggacagcaagttgtcttttgggtaaacgaaaaccagacggtttaacagcgcgttacgccgttaaaccgttagcccttccaagctccagagtcgcttcatcatataatttgatagcttcacctatattatcacttgggacgtttaccaacagactccctttccttttttctgttcgatgccctacaaaaaggctgtttgcggccgcttatttccgtttattttcactatttttgcagtatgaaaatgaagacagacgatacattcaatcatgcccatgccgacaggcttctgctccccaacgcctcattgcttggggaggtggagaacatgctggccgacggacggtcggtcatgctgaaggctacgggaaacagcatgctccccttcattgtcggagggcgtgacagtgtgcttgtacggcgtccctccgggatacaggcgttacaggtctggcaaatcgccctggcacacctgcccgacagccggtatgtgctgcaccgtatcgtccgcatccatggcgcggagattgtcctaatgggcgacgggaatctaaaggaaacggaaagttgtcggtttcccgatataacgggagttgtcacaagaattatccgtaacggccgttatgtggactgcgacgcagggggtgaacggtgcaaggcgaagatatggggcaggctgctccctattcgccggtatttgctgtacatatacagacgggtatggatatgaaggcgggaatgagtatgaaagaaggagcggaatggctgtggaacgcctcacggggatatcgctcccccattctggcgggtattcttgccgggacagttcgcatcggcgtgtccctcacgttcgtctggttctgcaagcacctgatagataccgccacccatcaggcggacgggaacatcatcctgggactggcggccatggcgggatgcatcgtcctgcaactgctgctgtccgcacttgtcagccgtctctatgcgcacacggagatcagcctgcgcaacagactgcggcaggatctgctcgaacatatcctgaaaagccggtggaacggtcgcgagacattccattccggcgatatgctcaaccgcatggaggaggatgtccgtaccgtgacggacctgctggcgggttccatccccttggtcggaaccacgctgttccaactggccggcgccgcgctgttcctgttctgtctcgaccggcggatggctgtcgtcatcctgcttatcatgccgttggcgttgctgtgcagcaagctctacatgaagcggatgcggcgtctgacacgtgagatacgggcgacggacagccgtgtgcaaagccatctgcaggagaacctgcagcaccgcaccctgatttccgtcctggaatgcaccccggtggcagcggacacgatgtcctcactccagtcggggctgaaacggctggtgatgcggcgcaactcattttccatcttttcaagtatcatggtgcaggcggggttcgccctcggctatgtgaccgctttcgcatggggaatatacgggctggacaccggtacggtaacattcggcacgctggccgccttcctgcaactggtggcacaggtacaacgccctgtcgtggagctggcccggcaggttccggtgtttatcggcgcactgacttccgtggagaggatagacgagctcaactccatgccgctggaggaacagggcgagcctgtcatcctgggtggcaaggctggtgtccgtgtggagaatgttacttttacctatcccggcggcagacgtaaggtgctggaacatttcacatacgatttcaagccggggagcctgaccgccgtgctcggggagaccggcagcgggaagagtacgctggtacggctgatactggccttgttgcagcccgacgggggaaacatcacgctgtatgacaagacccggcccgtgcccgtttctccactcacacgggggaatttcgtgtatgtcccgcaggggaatacgctcgtcagcggcacattgcgcgacaacctgctgttgggcaatcccgaagctaccgacgggcagatgcgggaagcgttgcatacggcggcggccgattttgtacgggaactgccgcaaggactggacaccccctgcggcgagatgggaacgggcataagtgaggggcaggcgcaacgcatagccatcgcgcgcggactgctccgccccggtaacatcgtcctgctggacgagcccacctcctcgctggattccgataccgaacggacgctgctggaacggctttcacataccattcaaggcaagaccctcatcattatcacccaccaggaacagacggcacggctctgtaacgccgttatcaggatgcatccggtgggctcccccggcaagtgacgcctacgtgagactgcgggatggccgggaacggggccgatcgcgcaggtataaaacaaaagcagggaagtccggggcttatcccggcttccctgccgacggggaggcggcatcattgctatgcgtgcagtccgactgccatatcaaactggttggatgttgagatgaaattatggcacgcatgcccgcttcccttcgtatataattccttatccggatgatacgccgcctcccgatgacggacagccgcggtatgaattccgataaatacggtattccaaatatccatatccgaaccacgcctggcccggatatggataagcaaacaaaacaaacaaatgatagcggatttaattcgtacagccggaaataccacattccacggctgtggtatgaacccgccaggggtatatattgttctgacagtgtgtcgtattcatggttcatacagttcctacagggcggaattgtccatgtcttgtgccgcacttccctgttgtcaatatcccggattttgcgtaagcgcgggcaaaaggtttatttcggattgcggaaaaggcatgagaagctcgtaggcttcgcatccggccacggcctgtgcctgcccggtccgtttcaacatgatccaatagccccagtcttgcttccgcgttttccattcgtccggcagggccgacttgtccgcagtgtcctccataccggcctctttgagtagcagggcggttttcgcgggtgtatagttcgcaaggctttcaccgaaaacgcggtacatttcgggctcggacgattcctcgaccgcaatgctgaaatcggactgacagtcgcgaagcaggtatcccgcctcgtcattgtagcccaggctcaaagcgatttcggcacggagggccttgacggtctccatagtgatgcgccacccgccttcggggaggttgtgtaaaaagtaagaatcaagtgttctttgacatattgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggattttatatctttgctctgctaacaataggattaattttatgggctatattcaaccttttgaccgtaatcaactgactcttcccgagtctttagattcttatatctcttgtgagaaccctgttcgtctgattgatgtttttgtcgatcagtttatcaaattgcaccctgatttttcatcttataaaggtaacagtcctacgggccgttcggcttatagctttggtactttactcaagctgtatgtctacggctatttaaacagtatcagttcttcccgtaaactggagcgcgagactctgcgtaatatggagttgatctggcttctgggtaatctccatcctgatcataagactattgccgatttccgttccaaacaaacttcgggcattcatgaatgttgccttgatttccgccgctttctggtcagttccggttatatttcaggcaaactggtagctgttgacggcagtaaaatcaaagccaataccaatcgtgacggtcttactttagatggtattaatcgacagttagccttgttggatacccgtttagagaagtatctgcaccagcttaatgaaaatgatctggtggaaacagcccaggaacaattatccgaactctcggacgagccggtgtggagagctccctactggagaagatagcccgtttgagccaacaggttgaagaacttcaggcggaaaaacagcgtatgctggatgaaggttcccaaagaagctttccttctgaccgcgaagctcgcctgatgaagacccgtaacggttttgttccggcttacaatgtccaatcagtggtagattcccaacatcacctgataggtgccatgcaggttaccgaccacccgaatgactttgaagaccttcaaccttcgattcatgccatgcaggaagaccttcaggtagaagtatcccaagccgttgccgacaccggttatgctaatgaagaacagattctggcccttgaagaagaaggcaaagtgattgccgttcctttcaatgaaggagaccattctcctaaagaagatcgggagcacggaatcttttttacctatgatgcagacaatgactattatatatgctcccaagaaaagatattacctattaaagacaggcaagttcgtaaacatggaaagatttatagaaaatatcagggaagagactgcaagggttgtcccttgataaagttctgcaccacatcaaaaaaaggccggattatctaccgaagggcagatgccgaacccataagacagtatatgaagaagtgtaaggggatgaaatacaaagcgcttatacgtttacgaaaaacatgggtagaacatcccttcggaactcttaaatactggatggggcaaataccactcctactcagaggaaaggaaaaggtacaggctgaaatagatttgtacgcaacatgctataatctaagaagagtgactaacattcaaagcatacaggtactattgcaacaagtccactattggggtattaagtatacctaatagcggtcattcgccaaaggacaacaatagaaataccaaaataaagagataaagagcattgcctttttaatacaatatgtcaaagaacacttgattcttactttttacacaacctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaaacgggtgatgtcttgcagttcattgagcagtccccaacaaaggtcttgcggtgaccgtacgggggaatgcaggatttcatcgtaattgttggaagtggcgggcaccgtaatgtaaggcacactgccccacagttgtgacaggttgtaatagaccatgcatctcaaggctttcgcctcgttgatgtaagcggtacgctcataggagccgtcaaaggcttcaaggcatttatcaccatattggcgttgctgatgacaaggtaggccgcactccacacatcggccacatgactgtcatacggagtaatgacggacgcagggtgttcatcaaagtctttccccgtaagccttatcttctccagcagcaactgcctgtactcataactccgtaagttgctgtaaatgccaaggattgcattttgcacagctttcctcttcccagaaactttcttcctcgttgggatagatcggagccggttctaatacatcacaattgttttccacctcctttctcagctcgttgattttttcctcgcctccatcgtaccgggtaagcatgacggcggaatcaccatcggtgagcgacatgctgttgcccgtaatgcctgccaccgcgacaagcacttcccctactgcgagtttcatggtaagcagattctctacgagcgtgtattagaacgacatgccttccaccgtccatcccgtatgatatccggtcacatctggtattgacgagtaggtgtaagtcaccaactcccctgtcccttccttgtgaaattcaacggtataaatcgttccgttctcggtgctgtaccagtttccggtcaaaccgccctgcacgataacatcctcgtcggagtcggagcaggcagcgagtacaaaggcgcacgccatgaaacataaaaaagtgcatatattcatcataattgtataacagatggtttgtattcagatcataattcataataccatgtcaagaaatccttccggaatgacaattgacaggttaataatttttttctgacaaatagaaatgtaaggaagacagagtcttccgccttccttacaatccccgcgcttttcacaaaggacataggtcttaacatctttttactttcccggttatatttgttttccgaccgggaaacggaaatatgtggtctgtctgaaatccggtcttgtgtatcgaaatccgcgtcaaggctttcgcccagtctgacggctgaccagaatcggacaagttcctatatgaacaaatgttttattccccacgtgtgataaccgcacggctcaaacgcgggtcgttgtagaacatgttgtccacaccgcccttgtagtcgatgcggagctgtttctcgctgacgccgaactctttcaccaggcagtcgtaaacgttctcagcgcgttccttgctcaggcgttcgttgcccttgctgctacccgttcccgcatcggcataaccggtgatggtatatacggtttccggatcgcccgacttgatgatttcggccagcagacccaagttggcgcgcgcctcgttgctcagcttcgtcctgttgatcttgaaggtgacgaggttggcggaggcaatcttcttcacgatggtctgtgccttctgtttgtcgccatcggcaagggctttcttcaagcggtcgttctccgcgctcatgtcgttcagtttccggcgcatgctttccagatcaccataattgtaacggtaaacggtcttgctgcggtcccagctgcgttgcttgaacttatacgtcaggccgatggtggcggaaaggttcccctcaccgaaacggccgccgccctcaccgtcgaaacggtcgttgacgaacatgccacgcacgtcgaggttcagggccagtacgtcgcagaagtgccaggaggtcaggataccgaggttggcgcttacctccttggaagatggagagtcatagacacgtgcccagccgaggccggcataaggactgaggtcccacttacggttttcgttgtaaccaccgaaaaggttcagcacattgaagagcacatcggcgtggaggttgctcatcttgtatttggaatattggaggtcgtcgcccggaacgccggcccatccgggcacatgttcgcctgtcccgtgggtgatgtcgcattcccagtcatcacgtgtggcgcccttgcttttcagtccgctgtacatgaagcggataccgattcccggagtgaaccacttgccgatagcaatatccagtgccggggcaatgcggtcgccgaagtctatttgcttgtcatggtcaccaaaatacacctgcccaccggcacccacgctgatgaaccagttgtcccaaaaacggttggtttccaccttatacttgtccgtactgtactccaccttttctttcgtatcggaagtctgtgcgaaggccggacaaagagccactgcgcacaaggcggtcaaaaagattttcttagtcatattcaatcaactgttaatgatttgtttctttatattactcttggcactgatagcctccgaaaagtattgatgccaagaataagaaaatttcttgcttagaagcaagagccaggcttactgctttttcagccttacgacaaaggtgccgtgtgccgcaagcgagccggtcaacgatgacgaagcagaaagggttcctgcgtctttctgtccgataagatctcttgccgaataagattcacttaggtcaagagcatcgtagtcggccatagaaatggtgtaagttgcagaattatcgctgaggttgacagcggcaatcgccacatcgccgtcagcgaggtctttctgatagtaatcaatgccgtcagcactcttgatatactcggcgccctgccctaaggcatcttggttgatggcgataagctcctcgttcttgacaagcgcgaggtcgtgtgccaagtcggccgaactcatatccttggtcatgtcgaagcccagaaggataggagaactccacatgcaccacatggcaaacgaggtctcggcttcggttgaagtgagtccacccgcctgattgtaaacgcagtcgctcgacgactggccgctaccgcggataccgacgcaaatcatgtcggcatcattgtaacggttgattccgacatacggccaaaggtggcgcatcagtacgatggtgttgtgcacacccacgccgttagcattctcatcgccgtcattctttttaccaaacagaccactgtcgattttaccccaccagccgtcacggtggtcataggtcatgcgccagcaggtagcaccggtctcggcaccccacttccatgggtcgtggataccccattcgcacacgtacagcatcaggccgcggtcgttaagcgccttgcccatcttggtgtagagttcctgcgccatttcggacgtgttccaatagctacccagaccggcatatccatcaacgaaagtcgatggagtcgcaccgacaggagccatatcaaggtcataataccaatcttctttcacgaagtcatagccccagcccttatagtcctgtgcatggagttcctcgtagccgtacgatgcgaagtacttctcgcaggtcttggttccgcaatcggtgtagataccggctttcagaccgtagtcgtgaatcaggttcgccatgcgcgccatgccgtttacgccattcgccgtgggaaacttgcttgcatcgggaatctggtggccgttgtcgttctcacttttcacctgccagcagtcatctacgccgaagtatctgtaaccggcgtcaatgaggcctttttccttcattcctacaagctggctcgcgaggatgtcgtagccaatcttgtctttaaagacattccaggtctgccaacccatcatgggggtgggtgactggagatcggcggcccggacggccacgtggagcttgatgccttctttataggtagcgccccctacggtgaattccaccgaatagacatagtcgccggcggcgggagccttaccttccacaaggcagcggccggcgttccaggtcagtccctccggcaggttgtagacacgcttgacgccattctttacgggcacaaccgcatgatattgctgcgaggtgctttgcggcacgcggattttgtgcatgaagggttgccccgcaatggcaaaaacggtgttggcgcatgccagacggctctgcaggccggtcacccaagcggcgttctcctccttggcatcgggattctcctccatcgtccacttgtctttgaagcgcgacagggtgagaggtaccgtgtaataggtattggacttgaacgcatcggctttcatcgtctcggtgaaggtgatgatgtgcaggttggtcttgatctgaatgctgatttccgtccccgcaatgcccgtgacgggagccacgttcatgtagccgtggaaggtggaggcggacagttccggcgtatccgtccattccatggtcacggtggaggcatcggtggccggcgtgaaggtgacggcacgggtggaaaggtcacaagtgaagccgccgccgagctgcttgtcggggacggtgagcgacacgctcagcagcctttcacccgccacgtcggtgccaccggcgttgatgtcgaacttcaagaaggcgaagatgtgctcgaaagtgaatcttgaggcggagctgccttggggggtgcccaccttccagtcgccttccagttcgcgggtggcggtggaatagtgctgggtcagcggcagcgtgcccttgaaagccgtgggagcggtgcccgccgtctccgtatagggatagtaggcatacaggggagtctcaccgttctggagattacctgcgaaggaggtcttgtcggtctcctgatcactctggttggtgaagcaggcattggcagtcgtggcgctgtacacgccgatccggtcggctggcagccagttgatgccaatctctccggatgtatacgctgtgggatcgacagccgtacgtgtcgctggctcttcaagtgcaggagctgggcaaacagcctcgattacggtgttgcctcccggtgataaatcttggtcgtaggcattacaagctatcaggaatgccgatgcggccagcacggttattgcgtttgcaattgatatctttttcatctattttcttttctatagaattagtttgcaaggctgcacgggccgtgcagccttgcaggtaaaaaggaatcagaatacagtaccaccgttggcaatacccttcgtgtcacccgaaggctttgccttggcagcggaacggcgggcgagcttgaactccggatccgcattgtgctcaatcacggcctggatgccttgagtggtagtcgcctcagtgcctacgcagttgaacattacccaaccccatggcttcgctgccggtttgttgttgttgtgaagccaaaggttgttaagggtagaagcaacttgtgaaggatagtaatattcatcgtcagtgacgaaatgttcacgtatagcgccgcaacctcccaaataggtcatcgagaagttattatgtttggttgattcgtaattatcgctgtatgcggcaagaacggctgttgcgttgtcttgaatgccgcttcgccactcaagaccagataaacccttagatttttttatcggattggcacaatcagagtagatgatattcatgttctcggtcagagccgaagccgatgtgccaccggcattcttattaggttgagcgccataaggcatgggcgaataatacacattttcttcagcaacctcattaaaggtattcatccatacattggctccggacagttggttccatgcgtcggtgtatccgtcgttaagctgcaccttgacaatcactttccccttgacgtcaccgatggtggtgttgggattgataccggttgcaatcagtcccatgtcttcgactttgtcaagcacgactttcaggcggctgtacaaagtggacaactgtgccgtagttatgccgctaatccagtcggagatggcgagcacgcagaactcatccttgtgggttccggacatctccttttgcagtgctatcagtacgtcgccgagggtccagtaaccactgttgtcagatttcaatacgctattaccatcagaatcagcgatacccaccgacgtggagccgccatctatcgaggaggtctgagcgatggtattgacatggcactggaacacacgcacaccggcattgaactggtctttcaattccattgtttgagtcttcttgtatgtgtccgacatcagatagttgaacgacagcacggaacccggcaacgaaatctcggaaaggtagatgttcggatcgagctgcgacagccaaatcgtgtaatcgaacttcaaatctttaacgttaatcttcggaagtttcacgaagtgaatctgcctcggctcgaagttggtcatattcaaattcttggtcagagtccgtgcatctgcagtcacgaccgttaccttacacaacgtgacattcggattcggaatcatgaaggcgctcaccttgagctggctgccatcgtccatcatgacacccaccctgtcaccagcttcatcggcgaatttagtatcgatcgtaatgctgttcgaggcgtcgtcgccgaaggtaaattcctttgatttgtaatcgtacgtaaagctaccggcaataggagcgtctgcctcgatgatgacagaggtgacgcgcacatcactctgcgtattgttcttgatggtgccgttcacggtaatgtcaaccatcgatgcgaagggttcgaactccagattcacggtcttctcggtagcgggattataacccgttttcttcgcgatcatcagcgcgcagtccatgtcagcggtagtctggaactcaccaaccgcttcgtccgtcatcacttccgtggtggaagccgtctgtctgtcgggcattgtggcagaaagcgatgtgtccttgccgctacccgactttacagcctttgccggatacatggcatagaaatcgtaattcgaaacgccacttgtctgcacgccaacatcgccgtccttggcaaccggagccggccctaccatgtccttcgtggcctggacggtgtacgaagcctgattggcgcttgccaacgcctggggggaatagatgtagatgtggtccaaagaagactcatagttccagaaaatcttccaggaggtagcgtccggatccgccacatccgcgggatcgtaataggtgcgcgtccggttagactcaaccgtggtgccgaaatcgaattccgtaccttccggcaggggatcgctacccgacatattgtcatctgtacaaccggcaaagcttaaagccagcaaagaccaagcaagagccggaatcaaaaatctcttattcatattcattcagattatgttcttattcattagttattatcccaagaatcattagtaaagtcattcgctgttccaaaagattggttgacttcctgagccgtagttgttgtaccgggcgactgagccgtgtgactagtagagccgcacaggtttccttccaattccacctgagttttcttcgtggaaggagactcgtaagtttttaagcctttgttttcattttcgtccatatactttaatgttttaaaaagttaatgtatccttatttagtgataagctgccttatacggcttccgtatagggcagcatacgcccccgtatctgtaagggaggttccgtcatcgcctccggacttgtcccgggacctcttgacggggctgtgccggcatggattgtcttttccggccacccgttaatctgatacctgatttcttgtgtcataatgtaattatatttaaaaagattaaacgtaaatgcttgaagtatatcggtcatttccttctcccgtgtttcccgtatccgtaaccatagccatacccgtatccatatccgtaaccgtagccacggcggtgcgggcccaccccgttgaggataattgccatgttgcggagcttgttatcgcggtaaagctcctccatgtcgggcagcaggcggcggtccaggcggccggcgcgcaccacgaagatggtgaggtcgctgatgcggttggtgatagtggcgtccgccacgatgcccacggggacattgtccacgatgatgtagtcgtagcgttggcgcagttcctccaccatcgcgtcaagccgttcgtccatgagcagctccgcagggttgggtgccaccgtaccagatgagatgatgtcaaggttgtcgaatttcccgtcggtgtggatgatgtcgtccaggcggatggagtcgtcggccagatagttggtcacgcccaccgggtgtttatggaagtggcggctcagggtgcccttgcggatatcgaggtccaccagcaccacacgtttccgggtgagcacgaggctcatggcaaggttgcgggaaatgaacgtctttcccgcaccttcattaaacgaagtgaaggtgacgacttgcatcggtttgtcttttttcaccatgaatgtcatgttggtgcgcaggatgcggaaactctcggccagcatgccgtcttcctcgccgacggcaacacccgctttcgccgcctccttgtcctgcggcacttcgccgaggaaaggaatgctcaccgcgcccttcaggtccttgcggctgtgtacccgggtgtccatgaagaggatcatgaggaacaccacgccggggacggccaggccgacgagcaccccgagcagcaggatgcggttgcgcacgggtgagatgggtcccgcgggtccgtccacgctgtcgatggtgcgcgcgttgttgtcggccatcgcctgcgagagggcgttctcctcccgccggttgagaaggaacatgtagagcgcctccttgattttctgctgccgctcgatggagagcatctgccgttccttggtgggcacggtggtaaaccgcgcctgtgcctgctcctggcggctgcgcgcgtcgttgcgcttcatgttgatccccacaatcatgttgtccaccgcacggatgatactctgcctcagggcgtgtatgctgttgttaagctcctccaccacggggttgctctcgctgctgtcggctatcagcttgtcgcgcttcagcttcagggcgttgtactggtttatctgcccctccacggcggcgtcgctgatgcccgtccccgaggggatgaggtcacggcttttcgtggggtcggtgaggtactccttgatgaaccgcgccagtttcagctgggtctcctgctccagcgcgtcggcgctgtaggcctgtgcctcgcccatgtagcggccggccagcgagccgatgtccatcacctggttgtgctgcttgaacgattccagctcggtctccacgccgccaagctcccgctcgatgatgagcaggcgctcgttgatgaactcggaggtgttcaccgccacctggttcttgtcgttgacggcttccgcgttatacacgttcaccagcgtgttcagcacgtcctcggcacgcaggggcgagccgtccttcagcgagagcacgaggatggacgactcgtcctcctcctgccggattcccatgctgccctggaggcgtcccgccacggcgttcagcgggttcttgacgacgtggatctcgcgacccgtccacgacttgccccagtggtcggtacccgtcaccaatatccgctcgccgccgacggccagcgtgtcgttcagccgcacgtcatagctatccttggcggcaggcagccccccgaacccggaaagcgtcaccgtcgcatcgtccttgggcgtcaccacgaacgagatgtgccgttcgggcagcacgttgatgaaggagacgttcaccggagacagcgtatagagctcgttcatacgcagcccgctctccacacggtagtccacgtcggcgtgcaggcgctgcaccacctcgcgcatcagccgtttggaacggaactggagaatctcgttggccacgttcaccttgttgatatagttgtcgtagcggtcgagccccgccgtggaggtcttgttggacgggtccttgatgatgaccgtgacggagcggaagaacaccagcggggatttggcgtagtggtaccacgccatccccccgaaaagcagcacggacagcacgaaccacttccacttcgacagcagatagacggacaggtccactaagttgacgccctgttcgttcttgttggataaactgttgttttgcataattcagagatgtgtttacttgatggcccagatgacggagcagacggccgtgatgaacgagaggattccggtggtgtacttccagcccttgtcctcgcggtcctgcttgcggtatttcggttcgacatagacgatgtcgttctgttgcaggtagaagcagggcgactcgaacagctccttgctgcgcaggtcgtgctggtacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcccaccgcgcccaggacggaatacttgaaattgaggaactccagcgacaccagcgggtccttgatatacttcccgtcgatgatgcggttgcgtatcagggcggtcacctcgctcaccttcagcccctccacatgcagcttgcccaggatggggaaactaatgttcccttccacgtccacacggtagcctttcttcacggcagcggactccgtcaccgcgccgttggcacccaccgagaaggccccgccgcccgcgttgaacgggatggacagctcggggttcttgctgctcacggtgatgtccaggcggtcgttggcatgcaccaccgcctcatacctggtgtcatacggatagccgagccccatctccatgtcctgcaggtagacgaatttcttcgacgaactgcaggaggagagcaggagcactgccaccgccacaatccaaaaacagtcttttcttttcattgctttctttgctttatttagggtttatcaatcatcgttcatagtccgccgttctccggcaggccgtcccgtacttcccgggctttcgcatcccgcacgtacaggctctcgaaacagagccatgcggcctcccggtcgggcaggcattccaaccgtccgacgggcacctgttcggttacccgtatcaggatacggcaaagttcgtcatgcaggcggatgtcctgacggatggcggagcaggagggcagcaatgcggcgaaagcttccggcccctcaagcggggtgaaccggttcgtgccggactgttgcaggcggacgattccggccacgggacggcgctcgttcctgtagcagggtgtcttcccgctccacggcgtgccgtagaccgataccatgccgtcctctatccgcagcacgggattgtcgtcattcagcaggcggcagtccggaaaggcctccagccattgccgggagtgcgtgctcttgcccgtgccgctcttgccgaggaaaaggtagcccctgcctttcaggctgacgcaggaggcatggacggaaacggcgtcccgcccgagtgccgcctgggcgtagaggatgcggagcatggacgacagtacctcccccatggacgggtcctccacccggaggaaggccgtggcatcgtcaaaagcagtgtccacagtcatgagatgtgcgccaccatccatagggccgtaacttatctccgtccggtaaccgccgggaatgcgcagaaggcatacatgccccatgtcgttggacgactcgtccagcagctccgcgcgtttcccgtcatccgcaaagggacgggtgtcggcaagcagccggaaaatccgttccccttccgggcattccccgcaccggaacggacggaaggagggcagcagcgtctctgcgtccagcccaccgggaaggatgacggagaatgtcagccccgccaccctgaaaaaatattcgtttctcatctgaggtttcctattatcagtcttaccgaaatccagaacgcctccttgcgggcgtaggcgctggagaagccgcggtgtttccagaaggagaggaaggtacgcagtttcctttcccaccttgcctgggaagccttgcccttggtgccgccgtactgtccgaagttccctccctccagcacgatgcgcagcagttcgggagaggaacatgcatccgtatccgcataaggaagttcggcgcgatgcagcccgaggtattccgtcaggaatgtatggagctgcgcgctccacctgagcaagccggtccgcctgtaaacggcttccagaccctcgggggagtagcttccgcacagggtgtggtaggcccgcgccatgtcgcagaactgccgaaggccgacaccgtgccccagcaggtgtttcaggaggtgggcgttcagcaacagcaggttcggcaggggcgacggcacggagattgtcgctgggaactccccggactggttgccctccggcagcccgtcccttccgcccggacggaactccgtgaacccgtgttccctgaccagtgcggaaaggtagactttcagcaacgggttatgaaggtcgaacagccgggtatggtgttccacctccactccctgccagctgtaacagttgcttccgtccggctgtttctccgtccggcacccgacccggcgcatcagctccgcggcttcccgttcctcctcttccgaaaggaaacagaggtcgatgtccccgcattcgcgcgtcagcggatgttcatagaaggcggccacgccctggcctttcagcagtacgggatgcaggccgttacggcccatccgttgcgccagcaggcataccaccgcgtccatcctcctgttcttccgctcgatgcggtcggtctccgccacccaacgtatcatcagggcgtcgccgggcagcagcgcttccggcaggtggtgcaggccgcggcagacaatgcccgtcacggtctggcgcaccgccatccggtacacgttccaccactgcgcgtccgtaagcgggaagggtgacaggtcgtccggctccctctcccacagccccgcacgcagcaggctgaacaacgccttatgttccgaagaaagctccatggaatccgttttctaaagcaggcactccggtaagggatcacaagatgcctttgtcctttcagtgtaagcattcaatcgccggtgccccgccgggacagcagccccatcttctcccattcctctatctggcgttccacatcgcgcagggcgcgcccgtattccacatcatacgtcttgcagagtccctccgccagttcccccgctgtacggccttccccgttgcagaccatctcccagagccgggcggcggtcccgttcaagctgtacacgttcgtcaggttcacgcaactgtcggagacttccacaatcatgtggcggttgcctatcctgcggagtttcaggtttgatttaattttcattacgcaagcatttttctgagtacccttcatccataactgcacatgacaatgatttaagatactccttatgtttcggatataattttcgttctataatcagatatgccgtaaccaaaccgatggtaacaattacggagtacagccacttgtcaatcggcaggtatatatagcctaacgatatggccaattgcaaaagcacataagtaatagagactgtcacatgtgaatgtcccccttcattagccaacaactgaaacaggtgcttgcggtgcggctgaagcaggttttcgtgcaacagcaaacgatggaaaatcgtcaacaccgtgtcaataccgtataccaccagaaataacagataagtgacattcccggtgaaaagcaccagtttcagcaaaataaagattacacaatacgccattcctacagaaccgacatcacccgcaaaacagatggcctggttcctgaaattaaagaagcagaataccaaagcggatatcatcagcaattctatcaatgtggcatctatgaaagccatttccctgttgagcagccagaaagtgaacaataccatcagactgaatgctccggtcataccgttgattccgtccatgaagttgtaggcattgatgatgcaaacacccagtatcatggtaggcagtaaaaaccaaaccttgttttctacaagcattccggcttcctgtaatagcaggaacattgccacaaactggacgaaaaagcgaaacctgggagacagggaacatacatcgtctataaaagccacactcgcaatcaaggtcattcctcctatgaacagaggataaccggtcgtattcagaaaggcatacatccagactcctaacagaaagatgatacctcctccccgtaatacgttcttcttgtgtgagctgcgttggttgggacggtctatgatgttgaatctgtccgcaattctcagataagcgaattcaccggcaaacagtaacaacaatgcaactaatcgttctataaacatatatctttagattttagagtttacttttcatgatacagggaagcgtacacttgttcatatccggccaacatacgttccttgacgaacatcttgttataatgtgcacgtgcctgacgggaataagtgcggtatgcctcttccgagcttgtaatcttcataatggcttttgccaaggcttccggattctccggttccacattaaggccggaatatccatttctattcacccagggaactcccgaaccttctatattggtcgccaccacaggcttaccacacgacatggcttcgatctgtaccaaaccgaacgcttcggttttccatacggaactcaggcagaacacgtcacaggcaccataatattgcgccacttcatcatcggtaacatatcctaaaaggcaaactttcccttgaagattctcctcatttatctgtttcaataatttgttgtatagaggcccggtaccaccgatcaacacaacataaccgtcatccaaatacctagcggcctctataagaaagcggaaccccttgtaggcaatcagacgtcctaaagcaaatatgattcttttccctttatattgttttctgatatcgctaaccctatctgctgacggaactatggcctcacaccccaaaggaacgattctgaacttgtgttccattccgcgcaaaaacggtgaattctctagatataccggtgacgtgccgattatcacatccgccctccttatcaaccatgtctgtaacggcttgtaaagtttcagggcatatttctgtttcaatatgtcgctatgccaatgcaatacgaccttacctctgtaaccggacagataaagtgccagattggccataggattcgggcaatgaatatggataatgtcgtaattcgggcaaagctttctgagtgtgggtatcaataagggggaaatcctcactgaattgacattacaaacagaaggcatggcataaatatgggcgtgttcatttaacggaaacacaccggctttttctgttgaaacacataacaggtcacacgtgacgccttgcattgagatacctcttacaatatccagtatggctttctccattcctcctttcaacggatagaattttcctagatgtagaattttcatagcagattcaaatggaagcaggcagtaatttttcaaacagttcccgccatgaacacacatagagtccctttatggcagtcgaaggttgggatgatagagacctatgatccccctccagcatttctttcataagtcttttcaattcttccggtttgtgttcattgaagtagcctacggcatgaaagcccgaagctgtagcatgagcataaggaagatctgcaagtaacatgggtttgcccgtttcaccgaattcggaaatcggcaagccccaggtttctactttggaagcatgtaccaaacaatgtgcggcctgatagtaaccatataacttttccttattcatatatccggcaaactcgattgagttcacatcgtgccagtttttataaagccagcgggtataacggttttcttttccggacagcgtgaccaccactttaaaacagccttttcctttttccttctccaaaagcctggcggcctgacataatacctcgaaattcttgtgacagtccggtgcggaagcatataggaatgtgaaacaaggcaaattcacgctctccgtttccactttgactgccatacgtcggggcggtgctacgataaatttctctttgcccacgcctaacatcctgctaagtccctcccttagccatgactgctgtactatcatatactgattacggtgaacattaatcctgtaagcataacgggtgaacagtgaaaatagggctatcttatagttgaaataaaaatcacgccacgtccgcttataaaaaggaaaagaagtctggcaatagaccgcctgtcgtttggctatcacacgaggggtggtgtcatgcagtgaaagccataaatcaatcccgggtaatcgttgagaaatgcggtgcatggttatatattcgcaccataaccggcgagtccaacttttgatgacatccggcaattcaatatactcaatgccgttgaactccgcgagccttctgtcgtgtacaatggctatcacacgtacatgcccctcacgtacacaggtagaaagatattgcaggcactctttcagaatagtcaaagtacctccctgacgcaatccgacagcagacacgactatgagttttgcattgtttcccatattagaataaaaaagaaaatataaaagactttcgttgtaacggactgtacatttaccggaagttttcaaataaatccgtccatcgttgcatgacagccttttccgaaaagcgggatgcgtcggcaaaagcattacgtcccatctgtttgcgcaaggtttcatcacgcattaatacaagcagtttctctgccaaagccggtatgtcatttgccggcaccaaataaccggttactccgtcggcaacaatatcggaagggccgcacttgcaatcaaagctgaccgtaggtacacctgcggtctgcgcttcgagcaataccataccaaagccctcgtaacgggacgacagaactagcacggaagcttcccgataaacgctttgaatatcgctggtggcaggacatagctcgacacgatcttccaacgataaatctaaaatttgctgttgcaggctttctttcatttccccttcacccacaatatgcagctgccaatcatcgattgagtcgcacacccgtctccatgctcgcaacagcatatcgaaccctttctgataggtgtaacggcctactgccaccaccgttttactctccaaagcggcgggaacatcacacgcaaatgtctgtgcattaggaataacctctatatttgcatgcccttcccaataatccttatcctcatgcgtgagaaccacaaatttatcaaaacaagccacttgcctctgctcattccggtttctccatttatcagccagcctccaaagtcctttgcggtcgtactgcaaacgcttgaagcgggagaaatgcacctcaagcactttcttgcttccatcctggatggaaggcaaaaaagcgacatcgttacaaaacatggaaacagtaatatccggtttgatgagattcaatacctttgtcagacgacgtttatgtttgagttgcttgaacggataatgaaccaacttattgaaaaaggattttccgttgttggtctcatagttcacatccagatccacacactcaatccgcccatccaaagcaaaaaaaggtctgcgtcccctctggtctgtggtcacaatggttacttcataaccatgtgctgccagataattggctttgttactcaatacacgctccataccaccggaattgcaggtgccggatatgcaatatacgattctcattatgcaacctgtctgactgttgaacattcatcttcttctgccatagaatcatctgccaccaagaacagagcataaataaagaagagatcggtagccacttttatccacaatacataattcatcaccagcaggagtatgaataacaccttatgtgccggatattttttacgacattcgcgtgtgcacaacacaaagaaataggcaaaagccaataatcccgttatgccaaaataaaatataaaacgaagataccccacgtccgtgcccatgtggtatgccccatacaaatacccggtataataaggatttgtaaaatgtggagaaaggaaataaccgtcaccgataatccatgtccttaactcttgcggaacctgttgccacatcaacagtaagtcatttgttgaaccggtcttgatgctacctttttccgacaagttaaagaatgcctcaaaggcaaagcgaaacatatccttgacttccacagaagaatagtataaagaagtaagaataggaattgttactgccaacacagctgcaaataacaaaaaaaccttttgagcagaaccgttaatcccttctctcagacaatataatagatacagaatggcaattatgcctcctgctaaagtagtacgggccaccatattacccgtaataaatatgaaaataaataagaatgctaacagaataatccgtccattgtttttattcgcatatctcatcaatatatgcgatagcaatatcaacgcacaagcaaaccggctacctcctgtgtccaaggaagctcctattccatacatacgatccaatctgttcaagttagccgtttcctgttccacgtatgtgtccacccatcctttaaataccggaatgaactcattcatcaaggcaaaaaaacattgaatggcgcaaacacctacaacataaaacgctatcaattctaccgtcacgttgccatgcactgacttcatacatcgagtaacgaaataggctccacctgtccatacccacatctgtatgatatagattgcataggtggtatcattggtctcgttgtataacagcgacacaatgcagatcagcgatacgacaaaagcagccagggaaaccgtcaccatgaaatggctggacacttgttgcctgttacggatctgattcagaaaaaacaataccaacccgcacaccgccaaataaatcttagtattaccaaccggtaagaaagtaaatgaaaacgggaacatatacaaggaacaggcaatccccgttaatataatagctataaaatgaatcatttgtatagtattccgtaaacaaatttaaataccagctggtaataaagttccaccagccaaaactgccttttcgcagccatcagttgcaccaatcgcatacgcagggtctgccttttgttcgccataatgtatttgttggcttcggggaaacaggccgtccatgtccgataagagtttttatcgttactgatgagtagcggcatcttggcattgagcttgaagaagttgatttccttttcatacttcccgataaaatgggtgaccagatagtccgtcgcagcctgcaagttacgcatttgacgtttcatctgttgttcaggactaagcctggtgaggctattctcgttttgttttacataatgatagaatgcgtcttttacgaatccaatactcttcgcatgtgagaataatttaataagtaccagcatatcttcccctacattttccccttccatgaaatgaatatcattcattaaatacaagtcacgttttatcatatagagccacaagttccaacgcatcgttcctgataacattcctctcagagctgtttctgcatcagcataacaaggcatgggcattcgccgctcattttgcctaaaacagagataccacccgcaagctataatatccttctgcccctgttccgatcgcaccaccatcttctctatcgcatccggctctatccaatcgtccgcatccacccaatacacatactctcccgttgcggcagccaaccctgtttcccgtgcagcagctacaccacgattagactcgtgatgaagtattctgatttgttgctgaagttgcggatagcgttcggccacctgcaagagcacctctacactcctgtccgagctacaatcatctacgaatatatattctatctccgtataactttgtcggaaaagcgaatcggcacatcgtgcaatgaagtcctctaccttgtaaagtggtgtgatgatactaacaaccattaataataaagctttatcattagatacaggacaccggacaaccgcaatttcaaaagcaagtacactaacaatttgtctttagatgtccggcggtaagttttataataatcgagtatcaacggatagtaaaaaaaattcttcatccgcgctaaatcccttagtagataattacgatttacataaagtttgaacaaccatatataatagttcaggacatgacaacgggcatgctctgtatccatgccgaagttccgtttcaatccgtccaatacacccaaaatccgttcaatggtctgcaaagaaacagtttcatccaacgcatacttgaaatccgctcccggctcagtataatagtcgtatccctgtccctgtttgaaagccaatgaagaacaatgagccaaataactccacacgaataccacatcttcgcccaccttcatctccgtattgaaaatcagccttaacgaccgtaccagagaagtgcggaacagcttcccccacggacacaaaaacgtcatatcagtaagccgggcttccaatgctctcttaatagcttccggagaatgagctgtgtcagtcggataatttgcacttggtatttcattggcccctaccgtatgataaccacctatcaccaaatccgcaacttcaccgtcaagtagggatcgcaggaaatccggttccagataatcgtcggaatccacgaaagtaatccattccccctctactaatttcaatgcatcgttacgggcagcacttactccaccattggttttatgaaccacccggatacgactatcctccgctgcgagttgatctgctatcttacccgtatcatccttgctgccgtcatccacaactatcacctccaaagccggatatgtctgacccgttatgcttcgtacacaacgctccaataaccgagcagcattgtaggccggaacaataaccgaaactttaccctgcaacatttctttcatctctatttcacactgtatattatctgagaaagatactccttgttccgctcctccgaaaattgtctgccttccggcacttcattcacgtatttatgcgggacaggtacttttttgggcgctctcatcagaaaccattcatactcgatgtcaatgtgcccaatatcaatagcctggtatcccacttcagctaaatcatatgccagaaccgtagcggtatgtcctaaagcaatcaaaacgagttttgccttattcacggtacaagctgccttcattatttcatcatacttggcaaaagcatccaatgccgggcaaagtatgcgttctatactctgagcattatcgaacaagtcattgccgacacctaaccggctctgttcaccttctatgatgcagagatcgcgtccctgccatatttggcggcaatgctgtatatagctccccttcttttttttattacgagcgtctatatagaaccgggtaaaataggagtctccatagagtcgtgtaggatgaatggaagcaaatatcatttcccggttatttacaaagctccgctcgatgaaccgtctggctgtaaaagagaggcttcgatggcttttccatacatagggaatgcacactatcaaattcagctcttcgtccgatccgtttcccaaaatttgctttaaacgccatgctaatttttcatcgtatgtttggaaatcacttttacgactttcatcaaacccctctttcagacaagtgatcatgtcaatttctccgtcaccatatcggcaaacggaacattcgtgtttaacgatatagtcgatggtttcctcagccataaggatattgaaagcattccttttccgcttcaacaaattatattgaagccaatacaccgcttttcgcaaaggcactttgatacccagccaaaatgaattcaatacggaagtcatagtattgtttaataataatcctttcttacaaaaaaacgttcgttgatattcctgagcagaagcacgaaccatctagctgtcccgcatatgtttctatactccttattccgatagactttcatgaaatccttaaaattagtacggcaagtagtccagtttatccattctagctgcttatatttcaatcccattagaatattttgcataaaagctttttcttgctcgtttttacattctattcttttcaaataggtcttcatccaatcagcatataagaaacaagctttcagttttagaagcattctgtcagaagtctctttgtttgaagaaatattgatgccagagaaacgaaacataaacaaaggttgcatactgcaagctacaccgtttcccgataacttactccaagttgcatcatcggtaaagaaagccaaaggaaaagcgacaaagccccccgttgagatcatagcttttcgtctaaacataaattcttgtacagtttggagccgatggttgcacaaacgctgggaaataaaatccaaacagctttcaaattctgctgaaggtgcagacgtaccgattaccccccccaaaaaaaaatgttaattttattaacacgacaatgaaataagtcgtattgggaatatttctcggtaagtttcaccatttcttccaaataagttggcgcatacatgtcatcatccgaagccattaccacccattcgcccgatgttttggggagacaataatcattccattgctttaccaaatctttaccgccgacattatactcgttctcataatatgccagacgttcatcctggaatttagcaaccacttccttcacattttcgggagatgcatcattgactatgatcaattcaaaatctctataagtctgtgaaagaatcgaatgaacagcctctttcagacaagtagctttgtaagccggtaatacaactgatacgaatggcataattattaaaatgattatttattcaatgatctaaaaaagatgtagccgatgtatttcagggggagtaggtacaagaacaacttccatcctctcgacagcccgatgcttttagcctctttgcgtacctcctgcaaaaaagggtggcgtaaattcactcgcccctgctgagccatgaatgccgacttcaaagcccttactttttgaaaggtaaacgcttcttttacctcttcgtagtatccgccagtcttcaatgctgaaaaaaggcaatcacagaatcggctctcatattccaagttggtgcggaaggtgtgcgataccgactctccatatacatgatacccatataccatgtcccggataacggcaattttctttgccttgttgcccaactgtacgttcatgatgaaatcttccgccataatcagttcacggggaatacagattgtcccgttatcaaacaagattctgcgaaatatccgaccggtgatgtattgggatattttgtttctaatcaacccgtccaaaaattccactgcttgcaactgcctgtcgtcctggttcatccattcttctgtcacatcattgccggaaacaatccgcttgttgcctatcacaatgtcacaatcagcacttttgcccagcatcacctgaagtgcatcgtcggcaagcgtgtcgtcggcatcaaggaagcaaatccattctccggtagattgctccacgccataaccacgggcagcggtcacgccttgattaacagtatgatatacctttatacgggaatcctccgacgcatacttgtcacaaatggctccactgccgtccttacttccgtcatccaccaatatcaattcccaatcctgataagattgagacagaacactatcaacggacaatttcagatacttctcagtattataaaccggaataacgattgatatttttctcattaccgacatttcttcattctacatcatactcgtcctatcaatatgttcaatacagagaccatatatttacggagcaaaaaataagtaccaatcaacagtataattgtgaaaagggctgcacaaatataacaattagccatccccatacccgtatctggagtaatgataaagaatagtatcttcagcattcttgacaagaccaaacagtgagccatataaataaaaacacctgatgcgcctatatttttaaatgtcagccattgtggaacacaatgtaacatccaacttgtaacattaaaagcaaatgcaataaatgcaaacatattcaccgttcttattaagacagccacattactataataaccttgtacaaacaaataacaaagtgaacaaagaggataaagtatgatagagattttaaagaactttttgaatacatcaaccaaattcatcctctgtagacctataagggctccatatgaaaagaagaggaaaacggatgccaactgatagagatgccaatcaatatgataaaaaccaaacaataagtataatatccccagaacgataatcaaatatgcttttattttttttaacaagaaatataatacaggagtgcagacaaccactaccatcaaatcacggacataccacaatgctgtattattcactctctgtcatggagagtaaatagagtgtatttacaaatgtattatattcatgattaaataatgtattataattataaaattaacatattttatctgctatgtgattattcacttcgtccagtaccgaccggtcaagttctttcagatagattctggtcactttctccgaggaatgtcccaaacattcactgatagtatgaagcggagcaccgttctcacgagccatcattgcccaacagtgacgcgcggcatgcaagcgcaaaggaatgctcataccgatatttcaggaaacctttttcagcgcatacctcatcctgttataagcttttttataccccgaataaggagtttcagattcatcaaccagagggaaaagatagtcaccggaagtatctccatacctttccagcaaattctgtatctgccggttaatacctatttcaagcaactgaccggtcttctgccttctatagcggattaccccgggaaaaatatcgctcttttttagaaaagcaatatctacgaatgacattccgcgagtatagatactgaacataaaaacatctctggccaagcattccggtgttccgactgaaagtgacaggttggcaagagacttcacctgcttcataggaagactttgtttgacggtcttttcagaccggattctgatattgcaaaaaggtgaaggaaataccagattcaattcaagacatccacgcctgtacaccgctttcatattatgtaaataaaaccctatcgtattcttgcccacaccggcctccaggagagtatcacgatacttaatgacaaggcgggaagaaagatgtgcaaatggaaaatcagtcttacacaaatgtttttgcatggaatgcagggtcgcctcatacgcttttgccgtcccttcatgcccggtgtcgaaaagcacacggattctctcacggaaatagctgtaaaaacccactttgccagtcagggtttcatagactctggatatatcacatgtcgtatattcattaccctccctttccaatatgcctatggctttatccaagattttacaaattttccggcatgtacggttcatgcgtcggacagtttccatggtatatacaccattaaagagtactcgtccgctaaaagaatcaaactcacagggggtaatgctgtatcctgtataaaaaactttctttttccgtttatgaaggacctgcacagccaatggataggccccgcgactattacaccgcccctttactaatactgtttttactgttgccataactgtattataaattactatatgaattaactatttacataaaaaagacgcaaaattcgcatgaaagaaacaaaacagcaaacaaaatacatgttatttgtaacaatgttctacaataaaaaatagaaaatcaacaagaatcctccattggtcaatgattaaacatgcacaaaaagaatactacacaaacaaaactgacacgggaaatctttcttcaacaagcctctcctcaaaataatagtatggtattaccttgataaatacggcaaggatatatttgctgttgtttaagcatttattctattaactgttcttagttttatctcaaaggaaaatatttcatgactcccggaaaagtcacaatatcaaaaaaaagctggccgatacccatgggatacttttcttgataatcctcctactccaccgtattctctgtcatgtactcaaaaacgggaacgtttttttcggcccgccgttcggatcatctaaaatatccgatgaatgattcttcggcaacgtcttgatgttgcctgcgatgtataaaacgaatcacacagaataggaaacaggagacatttcatgccaaccggtagccacttgtatccgatcgtcacgttccctctcgtccaacaacagcttaagcctaccttcgtaccacaagtaactttattgtttcactatttaatccgattgatttatggacaatctcaaagatttcaagaacgaggcattggtagtcaccaacgcctccgacggtaacacgccgcacatcgttcagggtattgagcctgacggttcactccgcaccaaaccgctggcacaggcaaagccctccgagacttttctgcacatcgaccgcaacaagtccgtgatcgggacgttcttctccaacatgaaccgccagtatgatcgaccgtcggacttccgcttctaccacctgccggtggaaatgttatccgcagccaaggacctggtggagatattcaaattcccggaagagaacggacagcttctttccaattacgccattgacatccggcagccggcacaggagcagagcatcacaggcgacaccccgcaacagaccacccgttggggagtggacgaggtggattggcagcagctcgcacgcatgggcgtaacccccgaatcgttgggcgaaacgggcatgcaacgcctgctgaacggccacgagtccgccgtcctcgacatcaggatctccttcgagggtatcgacttcgaaacgccggcctgcatccgtctggtggaatcagccggcggcaaaccggtcctgaacgtggagtgctgcaagcggtatcccgaactggaccggccgtacatgggtacggagctttctcccgaagtgaaagagaatctttccaggagcaacaatgccggctgcgtcgttgagctggaacttgccggaggagtgcgtgagccgtgtctgctctcgctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgtggtccgaaaagaaacagggatattacgacgcacgcctccagtataacgtctgcaagggcggcttcacttatgacttcaggggactgaaccgcaaacaggcgcaatcagagacacaaatgcgaagccgtgaactggtcataccacaggtactcaaaggcgtcgggctgacacccgaggtacgggagaagttagccgccggcaagacagtccatatcaaggacatgactgacaacgagggaaacttattcagtgctttcgtccgtgtcaaccacgagcgggcaaagttcgatttcttcaaatggaatccggacaagagcaaaaagcagggacagtcgcaacaggcggccgtccgtcaggagggcacgaagccggaaaacaccgtcagccggaaccgcccggtacagaaaaccgataagaaaggagtatccatttaaccattcacataaataatacattatatatgaaagttatcattgcagaaaagcccagcgtggcgcaggccatagcgtccgtagtgggcgcacaccaacggaaagaggggtatctaatggggggcggatatgccgtggcatgggcattcgggcatctggtcggtcttgccatgcccgaaagttacggtctctccggtttccgtcgggaacacctgcccatattgccacaagagttcaggcttgttccccgccaggtgcgagagggtaaggcttacaaggacgatcccggagtcgtcaggcaattgggagtgatccgggacctgttcgacaggtgcgagtccatcatcgtcgccaccgacgcaggtcgtgagggcgagttgattttccgttacgtgtacaactatctcggttgtaccaagccctttgcccgtctgtggatctcctcgctcaccgacaaggccatccgtgaggggttgcaaaaccttagggagggaagtctttacgacaacctttacctctccgccaaagcccgcagcgaggcggactggctcgtgggcatcaacagttctcaggcactcagccttgccgccggacagggcgtgttctccctgggacgggtgcagacccccacattggcgatgatctgctcacgctaccgggagaacaggcagttcgagccacggacatatttccggataaaggtttcggcggccaaggacggcatcgacttctctgcactgtcacagaaccgcttcgatgaccttgattcggccactgccaggcttcgtgagattaaggacggctgtatgcttgccgtcacttccgtagaacgcagggaggccgttcaagagccgccgttgctctatgacctgaccgccttgcagaaagaggccaacagcaaactggacttctccgcagacaagacgctcacgcttgcgcaaagcctgtacgagaagaaagtgctaagctatccacgtaccggcagccgttatatatccgaggatgttttcgacgagatcccctcgcgcataatgctcctgcggcaatatccacgcttcaccgccaccgcatccgtcttgccggacgcaccgctcaaccgccgtccggtagatgatgccaaagtcaccgaccaccatgcgcttctcatcaccgagaacctgcccgaaggtctgtcgcaggacgagcaggctatctacgaaatggttgccgcacgcctgctcgaagccttcttgccatgttgcgtcaaggaaatgaccgaagttgccttgtccgcaggcggtgagatattcactctcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagaccaagccccaaccactgcataccgagagttcactgctctccgccatggagcattgcggcaaagagatcagcgacgaacaactgcgtgccggaatccgtgagatcggtatcggcactccggccactcgtgcagctgtcatcgaaacattgtttgcccgtgactatatacgccgggacaagaagaaccttgtgcctaccgaaaaaggactggcggtttacgatacggtaaaggacaaaaagattgccgacgtcgaaatgacagcggcgtgggagaacaccctcgccaaaatagaaaccggagaggccgatgccctctctttccgccggaacatagaggtctataccgcacagatcgttaccgaactgctggccgccaccctcaatgtcgctccttcgggggagcaatgcacctgtcccaagtgcaggaagagccgcatcctgttcttcgacaaggttgccaaatgcgccgatgtcgattgcagcttcaccctgttccgtaacaagggaggtaagatactgaccgacggacagatcatcgagctggcgaccaaaggccgcactcctcttgtcaaaggcttcaagagccgtgagggcaagagcttcgatgccgcattggtgcttaatcctgactttaccataggttactccttcccggacaggaaaccgcaggaaaagaaaagcggcaggaagaaataacccgtccgaattgtatcacttaataatccgataattatatgaatcagaataaatccaatgtgccggtatccgtagcggaagaaccggatgaattatcttactaccgtcttaccctgttgtccttcctgcgtgagtcgcatccggatttggcggatgacgagtcttttgtcgccacccgcagcgagcaggccgccgaagccttcagcgcagccgtccgttccggcctgacctacgacgatgcggcacaacaggcgaacgccctgctttttcaggggttgcatttctctcctctggacacgctggttaccgtcctctggaacgagttcgccgccgaagtccccgaaggcagcgcacgcagcgtggccttgcagctgcttcccgaatgccggaaggtcttcgccggctatacgctctcggatgatttcatgttcagcccggagttcgggcagctctatgacgagctgacaggtacggttgtaatctggttggaagagaatggcttataataaaaaggcgcatctcagggacaatatagaggcaatccggctgatgttccgtttggagaaggaacagcgcaccgccacaccggaggaagcgggcatactcgccgcctactccgggttcggaggtatcaaggcggttctttcccctttcgggaaactcaccgacatactccgctggacacaggccgaccgtgaactgttccccctgattacggaacttcacaacgtcctgcgtgacggagcagctgacgagcgtgagtacaggaggctggtggaaagcgtgaaggcatccacctttaccgctttctacacgccgccggcgattgtcaatgccattgcctcttctttgggcgaacacggagtgtcgcccggccgttttctcgatccttcatcgggaaccggcaattttgtctcggccttccgatcgcaatgccactccgcatccggcaacactcccgaaattgttgcctatgaaaaggatttgcttaccggccgcatccttgcccggctccatcccgaagcgcaggtcaatatcaagggcttcgaggagttgcccccgcaccgtaacggctatttcgacgtggtgagcagcaacatccccttcggtgacatacgtgttttcgatccctccttcgacaacggcacggccaggcgttttgcgctgaacagcctgcacaactatttcttcgccaaagggctggatgccgtccgtgagggaggagtcctcgccttcatcacctcacagggggtgatgaactccgctatggcctatcccgtaaggcaatacctgatgaaccgatcccggctgttatcggctgtccgcctgcccaacaacctctttaccgactatgccggtacggaggtgggcagcgacctgatcatcttgcagaaggacacgctttcccaaagggaatatacgtcactcgaacggtctttcgtggaagtcggcacgcagaccgacgggacgacgcagaacgagtatttcgagcataccgccgccatcgtgcatacacgtggccatgtcggtaccgatccctacggcaagccggcacgcatctacctgcatgacgggggtatggaagccatcgccgccgacatgaagtatttccttgaccgcaacctctcggaacagctcgatctggacttgtatctccgccattcacccgtgcaggagttccgcaatctggtgagccgtccggcggaaaccatgcagcaacgcatcgcacaggtgcgggaaatcaaccggtccggtaacatgaacggacattccacttctacggatcgacagacgatacaggtggagcgtcggacttccacgccggagcagccctcaacggatgcccggccaaccgccgcaaagaccacgccggagccggtcatgtccctgtacgaccttttcggcttcacacaagaggagcgttcacaggtcaggaaaaggaaaacaaggagcacgaagaaggactccgggcagttgtcccttttcgatatgccaccgttggagcaacatcccgccccggccgaaccgactccccaagagaaagagcggcaggagcgggaacggcaggaacaggaacgccgccggcaggaggaagaggccgcacggcaggaacgcatgaagccccgtccttatccggccggcctgcatggacaccaccgcaacggctcccttgtggacgatgacgggcagataggctacctctccgccattggcggggctgcaccggtattcaacccgttggatctgcccgaacgccagcgacgccgtgcgtcgctctacatcgagatacgtgacacctaccatcacctgtacgagaacgaggcggccgcccatgccgcaaatccggcgttgcgcaccatgctcaacactctttacgatgacttcatccgtcagttcggcaatctgaacgacaggaagaacatcgacctgttccgcatggatgcgggcaaccgtgagatattgtcgctggaacgttacatcgacggccgggcggtcaaggccgacatcttcgaccatcccgtttcgtacaacatcaacgagatcacccataccgatgacgtgcacgaggcgctcaccgcctcgctcaacaagtacggcaacgtggacatggcgtacatggagtccctgaccgacaaatcgcaatctgacttgttggaggaactgcgtggacggatattttacaatcccctctcgaagaactacgagattgccgaccgtttcatttccggcaacgtcatggccaaggccgaacacatcgaggaatatttgcagtcgcatcccgacaacggcgaggcacgtatttccctcgaagccctgcggcagtcgcttcccgcgcccatacctttcgaggatctggatttcaatttcggcgagcgttggataccggcgggagtgtacagccgctacgcctcatggctgttcgacacggacgtgtccgtccgttataccgccagcagtgacgaatacagcatcagggccgacatgacctccccacgcatcatgaaccaatattcggtgcgttcggaaagccgcatcttcaacggcatcgcccttatgcgccatgccatccacaacaccacgcccaacatcaccaagaccgtattggacaagacgggcaaggaaatgaagatacgtgatccggaggttaccctgcttgccaacagcaagattgacgagatccgtaacggcttctccgactggctcatggaacagtcgccggagttcaagcggaaaatggcggacatgtacaaccgcaagttcaactgcttcgtccgtcccaagtacgacggatcgcaccagagctttcccggtcttgacctcaaggggctgggcattcccgacctgtatcccagccagaaggactgcatctggatgctcaagcagaacggaggggggatcgccgatcacgaggtgggtggcggcaagacgctcatcatgtgctgtgccgcctacgagatgaagcgtctgggactggcgaacaagccccttatcaccggcctgaaggcgaacatccacgagatcgcacagaccttcgccaccgcctacccgaacgccaaagtcctctatcccggcaaggaggacttcacgccggagcgccgtgtcgagattttccaccggatgaagaacaacgactgggacgccatcatcctctcgcacgagcagttcggcatgataccgcagtcccccgaaatccagcgtgacatcctgcaacaggaactggacagtgtggaagagaacctcgaagtcctctaccagcagggtgcggaagtgagcaacgcacagatcaagggcatggagaaacgcaagatgaaccttgaggtcaggctgaaagagctgctccacgagatcgaaacccgcaaggacgatgtggcggacttcaagcgcatgggcatcgaccacctctttgtcgatgagagccaccggttcaagaacctgatgttcaccacccggcacgaccgtgtggcaggtctgggcaacagcgagggcagccagcgtgcgctcaacatgctcttcgccctgcgcaccatccagcagcgcaccggcaaggatctgggagccaccttcctgtcgggaaccaccatttccaactcgctgaccgagctgtacctgctcttcaagtacctgcgcccccgggaattggagcgtcaggggatcaactcctttgacgcatgggcggcggtgtttgcccggaagtccgtcgattacgagttctccgtcaccaacgaggtggtgcagaaagagcgtttccgctacttcatcaaggttccggaactcgcttcgttctattccgagatcaccgacttccgtaccgcagccgacatcggcatcgaccgtccggagaagaacgagatactgcacaacatacccccgacgcccgaccagagggagttcatacagaagctcatcgagttcgccaagaccggcaatgccaccgtactgggccgcccgccactgaacgagagggaagagaaggcgaagatgctcatcgccaccgactacgcccggaagatgtcgctcgacatgcggctcatcgatccgctctcctacggcgacgacaaggacaacaaggccacccattgcgccgatatgattgcgaagtattacaataaatacgccgggcataaaggcactcagttcgttttctcggacttgggaacctacaagcccgaccagtggaatccgtacagcgagatcaagcgcaagctggtggaggatcacggcatccccgaagaccagatacgtttcattcaggaagccaagaccgagaagaagcgcaaggcgatgatcgaggcgatgaacgagggaaagatacgtgttctcttcggctctactgaaatgctgggcacgggagtcaacgcccagaagcggtgtgtagccatccatcatctcgacgcaccgtggcggccttcggacttgcagcagcgggacggccggggcatccgaaagggcaacgaggtggccaaactctatgcggacaacaaggtggacgtgataatctacgccgtggagaagtcgcttgacagctacaagttcaacctgctttacaacaagcagcttttcatcacccagctcaagcagaacaacatgggttgccgtaccatcgacgagggaggcatggacgagaagggaggcatacctttctcagagtacgtagcggtgctttccggaaataccgacctgctcgacaaggcacggttggagaagcggattgccggcatggaaggggagcgcaaggccttccagcgtggcaagggggaatcacgcatcaaactggaaactttcctggcgaaccgggcaagcaacgatgacatcatcgcccgtgtcaggaaggacaaggccgccatcgagagccgtatgcagtacgacaaggagggcaacaggctcaaccccttgaagattgacggcgtggcaggcgatgatccgaaagtgattgccgccaagctccacgagatagaggacagggaacgcacgcacggccagccgaaagtcatcggctcgctctatggcttcgacatcgttgtcaagaccgacaccaccgtcaaggacggtctggacttctgcgagaaccgtttcttcgtgcgaggtgaaggcaacttcctctacaactataacaacggccgcttggcggtcgatccgaaaaccgcctgccagaacttcatcaacgccttcgacagcatcccccgcctgatagagaaatacacgagggacaacgaagccattgagaaggaactccccgtcctggaacaggtcgtcggggaagtctggaaaaaggaggacgagctgaagcagctcaaggccgaccttgccgctctcgaccgcaagatcctgctctccctcaaatcagtggatgcgcaggaaaaaagcaccgacggagtaatcgaagtcgtgccctcccaaccggtaacgcccgacggacaggataacgcccccgccgccggcatacccgtcgccgatgctccgcccggcagttcctcaccgggcagtgtccccacacaggacacgccccctgccgagccttatgtccaccggatgcccgacttcctcgccgacaggcagcgcactccgcccaaactaagcggaatgcccaaaagcatcagcatcaaagaggcaatgggagcgcccggcggcaagctcgtcatcggaggcgtccccaagtccggcaacaaggacgatcccgatcctgaccggcccgaaaagcccaaacccaagctgaagttatagctcctgtaaccgaagccataaaaacaaccccactccgccggcttcccatgaaacagcggagtggggttttatactatacagacaaccgacattttaccgccgtaaaatttacggcgataatatatatgcaaaaatatattgaaattctgtatgttattacgcgtttttatgcataatttctgctgtttgatgaaatatgtatggggctattctttgtgtaatcttaaatatagaacatttttttaagattctttctctgtttgttaaagtgaacaaacccgtcctctcatctgttagaaagtctcaattttagatttaacctaaccagcatgaaaaaaaataagatactttttgtactatgggctttgtgttttttcgtcattcggacaaatgcacagacaccgctaagtttcgaagaatcgttgcacctgcttaatcagggaaatcagagtttgaagatagctgataaagggatagagattgccaaggcagaacgtgacaagctcaatgctttttggtatcctaccttgcagtctacaggtgcatttgtgcatatgtccgagaagatagaagtgaagcagccactgtctcagtttactgatccggcaaaagactttgtacattccattattccggatgaccagataatctcagctattctggataaaataggagccaatactcttgtctttccactaactccgagaaacttgacgactgttgatctgtcagcagaatgggtgctcttttccggaggaaaaagatttcgtgcaacaaatattggtcggacaatggtggatctggcgcgagagaatcgtgcacagactgctgcaagccagcaaaacctgttggcagaaagttattatggtctgcgactggcgcaacaggtcgtagcggtacgtgaagaaacttataaaggtctgcaaaagcattatgaaaatgctttgaaactggaagctgccggaatgatagacaaagcaggacgactgtttgcccaagtgaatatggatgaagcaaaacgggcattggaagctgcacgaaaggaagaaacagtggtgcaaagtgccttgaaagttttgttgaataaaaaagatacggatgagaatatcgttcctacttctccccttttcatgaatgattcgttaccacccaaaatgctttttgatatgtcggtcaatagtggaaactatatgcttaatcaactgcagctgcaagaacatatcgccaagcaggaagtacggattgcccaaagcggatacttgccgaatatagccctttttggaaaacagaccctctattcgcatggcattcaaagcaatttactgccgcgtaccatggtgggaatcggttttacatggaatctctttgacggactggatcgggaaaagaagatccggcaatcaaagctaacccagcaaacgttggctttagggaagatgaaagcacgcgatgatcttgctgtcggagtggataaactctatacacaattggagaaagctcaggataacgtaaaagcgctgaatgcgaccatcgaactgagtgaagaactggtacgtatccgaaagaaatcctttactgaagggatggcaacttctaccgaagtgattgatgctgaaactatgcttgccaacgtaaaagtggctcgtctggcagcatattatgaatatgatgtggcattgatgaatcttctttcactctgcggcacaccggaacaatttgtaaactatcaacctaaaccgtaacaaacaatgaaaccaactagtagaaccctttcatgggcattcgtcattattatgctggcagtcggtatttttactgctctgggaataatattgatgcacaaacaaccgctcgtcctgcaagggcaggcagaagcgacagaaatccgtattagcgggaaacttcccggacgtatcgatacctttttggttcaggaaggtgactgggtacgtcaaggagatactcttgttgtgatcaacagccccgaaatacatgccaagtatcagcaggtgaatgcattggagcaagtagccgtgcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaagaaaatagatgccggtacccgccgacagattgttgctaccgcgctgcaactatggaacaaaacaaaaagtgatcttacactggctaaaacaacttataaccgtattcttaccttatataaagacagtgttgtcacttcccagcggaaagatgaagtggaagctatgtataaagctgctgttgcagccgaacgggcagcctatgaacaatatcagatggcggtagacggtgcacagaaagaagataaagaatctgccgccagtatggtgaatgctgccagaagtacggtggaagaagtttcggcactattggtcgatgcccggctgacagcacccgaaaacggtcagatagctaccatctttcctaaacgtggggaattggttgcgccgggaactcctattatgaacttggttgtcatggacgatattcatgtagttctcaatgtgcgtgaggatttgatgccacaatttaagatggagggcacctttgttgcggatgtacctgccatcgataaaaaaggtattgagtttaaaatctattatatcagtccgttaggaagttttgctacttggaaatcaacgaagcagaccggaagttatgacttacgaaccttcgagattcatgcccgtcccactcagaaagtggatgacctgcgccccggtatgtccgtattactgacattaaatgaatgatagaatgagttcatcacaaacatattctccttttcgttccgtgctgctcagggagtggcgacggatgacttcacgacgcctttatctgtgtgtgtgtatcatcctgccgctatttacccttttcttcatggcaacaatcttcggcaacgggcagatggaaaacattcccatcggtattgtcgatcaggacaatactgcctcttcacgggcaatcacccgaaatatatctgctgtgccaacatttaaagtgacaaggcattttgtgaatgaggaagctgcccgaaaggccgtacagaagaaggaaatttatggttatctctccattcctcccaaatttgagcaagatgctatttcgggaaagaatgcgactctctcctattattatcattatgcgttgctttcggtaggtggcgaattgatggctgctttcgaaacgtcgctggctcctgtgtcgctctctcccattgtgatgcaagctgtcgctctcggagtggaacaagacaagatcactacattcctgttgcccgtacaagccagcaatcaccctatatacaatccgagtctggattattcggtttatctgagccaaccgtttttcttcgtcttgtttcaggtattgattttactcattactgtatatgcagtcggaattgagattaaatttcgcactgccgatgaatggctgtttgttgccaaaggaaatatggtaacggctgttttaggaaaactactcccctacaccattatctttattctgataggatggctggcaaattatgtgatgttcggcattctgcatattccttttcaaggaagctggttattgatgaatatgctgacagcgctttttgtcgtggcaacacaggcattgggattattcctgttttcactatttccggctatctctctgatcataagtattgtttccatggtcggctctttgggagctactttgtccggtgtcacttttccggtgcccaatatgtatcctttggtacgagatgcttcctatcttttccctgtccggcatttcacggaaatgatgcaaaatatgctctacggggggagtggttttattcacctttggccatcggctgtgatactatgtatctttccgctgctggctttagtgttacttcctcatctgaaacgtgccatagaaagtcataaatatgaaaaaattaaataagttacaacagttatcgttcatcatccgacgtgaatatctggctatcagtaccagctatgctgtattactggtattgatgggtggaatcttcgtgtacggattgctctataattatatgtatgcccccaatattgtgacggatgtcccggttgccgtagtcgataattcacatagcgagttgagccgtaacttcatccgctggctggatgctacgcctcaagcggaaatttatgatcaggctatggattatcacgaagctaaggaatggatgaaagctggaaaagtacaaggtattttatatctccctcatgattttgaggaacgggtatttcgtggagatgaagccgtgttttctctgtatgccactaccgatgcttttctctattttgaagccttacaaggagcttcttcacgtgtgatgctggctatcaatgacaaatatcgtccggatggagcagtctttctgcctccccagggattattggcggtagctatggcacagcctgtaaatatagcgggaaccgcactctataactatacggaaggatatggatcttatctgattccggccgttatggtcattatcatttttcagacattactgatggtcattggtatggtgaccggagaagagcatatgacaaaaggcatccttgcttatactcccttcggaaaaagctgggcagtcgctatacgtattgtatcagggaaaacgtttgtttactgtagtttgtatgctgttttttcattctttctattagggttgcttcctcatttctttagtattcccaatattggaaacggattgtatattgtattgatgatgatcccctacttgctggcgacatcttttctggggctggcagcctcccgatatttcactgattcggaagcaccattgcttatgattgcctttttctcggtaggactgatttttctttccggtgtttcctatccgatggagctgatgccttggtattggaaagctgctcattatatttttccggcagcacctgctacactcgcctttgtgaagttgaactcaatgggagcaagtatggctgatatccgacccgaatatattactttatggattcaggcagttatctattttatattaagtgcatgggtatataaaaagaaactcagctgaaagtagtattttagttgcatattttaaactgatatcgctcaaaagtataatatttcaaccaacgaataattaactatggaaataaaaaagttttgttgaacattttacttgattatctcgtccttttttatttattttgttaactattatttggagatagaccatagtactactttaaatacaactatttatatgaggaatattatactatttttattattactgccgttaatggcatatggacaaacatacaaacatattggagtagaggatggtttgagcaatcggagaatatacaatattcagaaggatcaccaaggatatatgtggtttcttactaatgagggtatggaccgatataacggtaaggatataaagcactataaacttatcgaagaaaacaaacaattgagttccgaaatacatctcggatggctatatgctgataaagaaggcgggatatgggtcattggaaaaaaaggacgtattttccagtatgaagaaaagtatgatcgttttacaatggtctataagtcaccgaaagtcactgatgccatcagttacggttatttggaccgtaacaacaatttatggttatgcggcaaagattctattttgttgtataatactaagactactcaggttatgcggcttcctaatttgttggaagataatattacggtagtagaacaggctgatgacactcatttctttatagcaacagaaatgggggtccggtatactcagtttgaaaacgaagctttgaaagtcattcctttagatatgcttgatcatgtctatacgcaaattaacagtctctatttccatcctcagcttcacagactttttgtaggaacttttagtgatggtacttttgcctatgatatgtctgctcatcaaattatcaaatcagatacgaagttgggtgatgtgagtattactcatatcagaccgttgaatcaaaaggaactactggttgctacggaaggaatgggagtacacaaaattgatgtaaatacttgtaatacctctccgttcattgtggcaaactacgaaagttataatgagatgaatggaaataatattaccgatatttatattgatgaagaaaaaagaatctggcttgctaattacccggcaggaatcacagtagtcgatttccgttataagaattatcgttggataaagcattctatcggtaataagcagtctatcgtcaatgatcaggtacatgcggttattgaagatagtgaaggagatttatggtttggaaccagtaatgggataagtttccaggattcaaaaaccggtcaatggcattcttttctgagttcttatgataagcagctgaaagataagaaccatattttcattactttatgcgaagtttctccgggtgttatctgggcaggaggatatacgtcgggtatttataagattaacaagaaaacattgtctgtagagtacttttcgccttttcttcttagctctgtcaacatacgtccggataagtatatcagggatatgattaaagattcaaaaggatatatatggtcgggagggtattacaatctaaaatgtattgatcctagaaaaaatactgtccggttgtatcccggagtcaatactgttacggcgattgaggaaaaagatactaatttcatgtgggtggggacagctactggactttttctgcttaaccggaattccggtgaatatcagtatatattaatgcctgtggagtcaacatatatcaatactctttatcaggccaatgacggattactgtatatcggtacaaacggctcgggagtacttatatatgatcctggaaacatgagttttgaacactattacgctgataattcggcacttgtatctaacagtatttatacgattcttccggaaatgaacggacagataatgatgagtacggaaaatggaattaccagcttttctatagaaaagagatcatttcataactggagtcgcgaacagggaatgatgtctgcttgttttaatgcaacttccggtgcgttacgtaagaataataattttgtttttggcagtgttgatggggcagttgaatttccggcaggtataaagttgccggattatgaatattcgaaaatgatattcagcgattttcatatttcctatcaaccgatttatccgggagaaaaagattctcctttagagaaagacattgataagactgatgtgttgagacttaaatatggtgagaatactttttcatttcgtgtttcttccatcaactatgattttccttctcattcagtttattattggaggttggaaggctcttcttataatgaatgggtacaactgagtggcaatagtttaattcgttttaccaatttaagtcccggcaaatataaactttatgtacgtgccatatcgaaggaagaacctagtatcgttttcgaagaacggcaagttggaattatcatatcgcaacctgtatggctaaatggctgggctatattcatatatatgcttctgatcgtctttgttttcagcattgctttccggataatgattctgaaaaagcagaaaaagatatcggatgagaaaacacatttctttattaatacagctcatgacatccgcactccgcttacgctgataaaggctcctttggaagagtttgttgaggaagaaacactgacagagatcggttcgcagcgtattaatacggcattgagaaatgtgaatgcccttttacggttgagcactaatttaatcaactttgaacgggccgatgtttattcttccgaattgcgtatctcagaatatgaactgaacacgtatatgaatgagatatgtaatagttttcgttcgtatgccaatatcaagcatattgattttacttataagagtgattttaattatctgaatgtatggtttgataaagataagatggattctatcttaaaaaatctgatttccaatgcgttaaaatatactccagaaaatgggatagtcagcgtatctatttctgagactaaagactcatggaagctggaagtcaaagatacgggaataggcattccggcaaacgaacagaataaactgcttaagatgcactttcggggtacaaatggcattaatgcaaaaataactggtagtggaatcggattaaagctggttgataaattggtgcaccttcatagtggtaagataaatatagagagtgttgagcaacaaggcactactatcactgttgttttcccgaagggtaataagcatttccgtcactcgaacctgatagatccggaaaaaaccggcagacaggaagctgtactggatgctccggttatatccgaagcggcggaaaagacaaacgatgagaatctgcaacgtattcttattgtcgaggataatgatgaactacgtgcttatctggtcaattcattatcaccgatgtataatgtacaggcttgcggtaatggtaaggaagcattgatcattgtaaaagaattctggccggagcttattctatccgatattatgatgccggaaatgcggggtgacgaactgtgttccactattaagaatgatattgaaacatcacatattcctgtcttgttacttactgctttgggtgaagaacagaatattctcgatggtttggatattggtgctgatgaatatattgtaaaaccgttcagcataagaatcctgaaagccagtattgccaatttattggcgaatcgggcattattgcgcagcaaatatgcgaatttggaaatagatatagaggttaagactcctttagcgaaatgtactaatagccttgactggcaatttttatcggctgtgaaaaaaacgatagaagacaacatcaataatcctgccttttctgttgaggttctcaacgatttgcataatatgagccgtacacgtttctattataaactgaaagcaataacaggactatctcctcaggaattgataaaaacaacccggctgaaacgtgctacgcaactattaaaagaaggtgagtataatattactgaaatctcggagatgtgtggattttcagaatccaaatatttccgggaagtattcaagaaagaatataagatgagtccgagtcaatatgctaagaaatatagtatttcttcttccggtattatagaagatgattcagatgaataaaataataagctgctttttctttgcagaaaaagcagcttattattttttaattagagacattacttgcgtatcaagtatttaataaacaaataacctcctaatacttgcaggcacattccgggaataccgatgcggaagtcctgaacagcattgtagaaatttcctatatacatccactctcccaatgttccgatgatctgataaaacaagactactcctgctaatacagggatagaaatgcgtccgaagcgttgcgcagcccatccggcggcgatagctaataatacggatttcaataggatggcaggcaatactgcgggcactggcataccaaagagcagagagtttatgactggagacaagatagcagttagcaaaccgaccttccagccatatttgtaagcaccgatcagagtgaagaaataaataggcagccaggttaatccacctagtggaatgagatgaaagagcctgggaaaaaggatattgccaacgatgaataacgaggctgccaaataggtcttcacattactgtaattcagtgaatagagttttactgttgtttccatatctttattcttttagaaattcaaattaataccacccatgaatgttgccttgggcatgggataccctgcatttatttcgtaacgttgtgccaacaggttttcacctttcacaaagatgttggcaaaattacaaacacgataacttcctcgcagattccataaaacaaaactatcctgttgctcggtgcctttattattaacgattacagaagtgtaaagtcccttaatatattgcattcctgtcgatacagtccagcgacctgcggtatagtctgctccgacatacaatttgtgttcaggagcggcgagaaccggattctccatgtgcaaccagctatagttggcattcacattccaatgagaattaaaccgataaccgatattcgcttcaattccccagttttctatttctccggaattgacgttcagcggaggcgtcaaaccgttgctcataattacattgtcaccattaatataatacaggttaagtccgtaatataaggcatcttccaataaccgttgggaataggaaagttcataactgaccagtttttccggattcagttccggattggcaggagcaaacatatacatttcccggatggtagggttgcgatatcctttgctcaccatcgctttaagttctgcacttttgggaagatgaaaagccagtcctccttgtggaatccattcagtacctacatgagagtgatgatctacacgaacacccgcatccaatgacaaccagctatttatatcctgacggaaatcgacatatcctgcaaattcatccatttgcttgtctactcccggtttccgctctccggtagccaagactttgttccatgattcccctccgaagtgctgatagtcaaatcctaccgtcagacgattgcctgtgaagaacgtagcactctgataccaggaaatgccgagcatcttgtctttagaattaaagtgtgatgtttgtggttgttctcctgttttatatccgtcattgattttatgccgtccccaattatagaaaaggctcaaagctcctgatgtcttctcataatggttttccaaggcaagcgaggtcataccacgtgtaatacgcgaatcattgtcgataagtggaacttgtatcgttcccggattggaagcattgaaatgggttacatttacatctccccagagtttccaggaagagctgaaatcatatcctaacttcgcgtatcctccatattgtttgaactccatatcgggacgatgtccgtccgtacgattgtaagaaccggtaacgatactgctgaaacgtcctttctttacacggttggaaaattccgtctgcaaagtgttgtatgagccataccctacctgcatattcgttcttactccctcatcctgctgtttgcgggtgactatattgattactccgcccattgcattcgagccatagagtacagaggcagggccgcgcaagacttccactttctctgtcaacatagactgatatgcatccgcaatcggatgtcccatcaatcccatatattgcggatgtccatcgatcaaaaccaataaacctgccgtcggactgcctccgataccacgcagactcatgccacctgccgcacctgtggacacaccatatcccataataccacggctggtagtaaagaatccgggaacctgttccgtcaatagcggcaaaagtgaaggttcatatcttttctctatttgttgccttcctactactgaaatagtcatgggaaggtgacgaatatccgtctcgttccgtgttccggtaactacgacttcgtcgatagtatagtttcttttgacttgtgtgctgtcttttccgggttgtgccattcctgaaatggaaagcaggctgccgaacaaaaacaaacaaactgtatttgttttcatattctgtttcgcgcttttatttctcctgcaactttttaccacttcttattttttcgaggaaatcacgaatcagcggcaatatggcttctgccgattcttcttcgctacacatcgtttctaccggacaccagcctgtgtgatcacgattccatataaaaggtacttcttgtacgaaatggacttttatatccgagcttcgtaataaatccaacgctttcgaactgatgatgtctgtatgaagttcccggatacctcccaaaatcatgagggcggcagcccccttccctactactttgtcggctatcgaagctcctttcaggaaatccggttcctgtgtcagcaaatcatataaatccgctacgccacgttgggtaaaggtacgtatgttgtctccattggcaatcacacaggaatatcctcccgagtgtaataagttgattaattcttccattataaggttccttgtttcagttgttctacaaattggtcaatccggtgcagttctttgggtatatctatgttttgaggacagtgaggtacgcattgattacatccgatgcaatgactagcctgacggagtttaggtacactgcggtcatatcctacaagaaatgcccggcgggctttgagataattctcatcctgtccgtttttaggaacattgccttcattgacacaacggttataatgtaataagacagccggaatatccagaccatacggacatggcatacaatatttgcagtcattgcaagggatggtaggatacttcagcattaactgtgccgtgtcttccagaaaatccatctcttcgtcagtcagcggttccaatggagaataagtacgcaggttatcctgcaaatgttccatatatgtcataccgcttaatacagtcaatatatcggggaacgttccggcaaagcggaaagcccatgaagctacgctgctttccggacggcgttgtttgaggcgtgccaccagattgtcattcagtttagacaagcgacctcccaaaagcggttccatgataatggatggaatcccccttttatgtagctcaccatacagatattcggcatcggtattccgggcatttgtctctttcgcatgcttccagtccacatagttaagctgtatttgtacgaaatcccactttatctcatcgtgtcgggaaagcagataatcatatacttcgatgtcgccatgataggagaatccgagattgcggatgcgacctgcttcacgttcttttatcaaaaagtcaagcattccattatccagatatcgtcctttaagggcgtccattccacccataccgatgccatgaagcagcatataatcgatatagtccacctgaaggtctgcaaaagatttatgatacattttgagggaagcttcgcgtgaccatgtatccggagagaagttggatagtttggtagcaatgaagtatttatcacgtggataacggcttagcgcaattcctgtggatttctcagaaaaaccttgcacgtaggccggagatgtatcgaaatagtttactccatgagcgatggcgtaatcgattaatccgttcactgcatcctgatcgatcacttcacccttaccgtcgggagccggtttgagaggccagcgcatacagccgtatcctaaaagtgacacgcggtcgcctgttgttggagacgtgcggtaagtcattttatcggtaggaatttccccttctgccgatgcactgcttgatgaagaagtgccttttgacgagcatccgtatagtatcgctgtcgatgtagccgcactgatacctacgattttgataaaatctcttctgtttatgtctttcttatttttttcttccataatcttgttctgatttaaatcatacaattctgtgcatctgatgtccggtcacgtaaatggcactgaaaggacgggatggacaaagattctcgcaagcaccacaaccaatacaccgttcgacattgattgccggaatcttcggtgagtccgctatttcgggatcggaagctaccatctgaatagcggctgccggacaatggcgggcacagttgccgcattccattccatcagtcagcggtacgcagttctccttgatccatacagcatgcccgatttggatagcggatttctctgccaggctggtcagatgaatggcatctgtagggcatacttccgcacatttggcacactccggacggcaataaccacgctcgtaggacatttccggctgcatgagagttgccagattaccggatggacgtaatacctgagtaggacaaacagagacacatagctgacaggcagtacaatgttgggcaaagttgcgtgcatttaatgatccgggaggataaatcggattctcccggttgggaatcttcttgtcttcaatggctgccaatcctccgtctacctttttctcctgtgctttcagtatggtagaagtagcgaaaatagtcgatgccgaaagaaaactacgacgggcattgtcaatctgttccgaggtcacggattttattttaaccgcttccgtattaaccccttctttcttttgaatacgtctggtatatttaatagctccttgcttacattttcccaggcaatccatacaagcgacacaacggctataatcaatttcatgggctttggcattaatacaggatgccttacaattacgtgcgcacaatccgcagctattacatttggaagtatcgatcacaggcttgaagatggagtatcgtgatatgaatcccaatacggtgccgacaggacaaatggtattgcaataagtacgtccgttacgccatgccaaaacaaaaagcacaataagggtaatcacagcaatgatcagtgttgaaagacttttcatccagacatccacttcatagaaagcatagctttctgcccgttcggcaaaatatgccaagagattatttccccattgccataccggagccagcagactggaaaccatccggccgtatgcactgtaaggtgccagtagaacgacaaaagcattcagtccggcaaccaaggcaaggatgaatacagccaatacaccatatctcagccattttaaagccggagaataacggaagcggttctttttctgtttgccggagaaccatgaaacagcatcctgaaatactcctaacgggcaaatgaccgaacaataaatacgcccgaatagtaatgtgagcacaataaggaatagcacgacacctatgttcaaggctaatactgccggcaggaactgaattttcgccagccatccgaaccatgtgtgcaatgtccctgtgaaatcaaggaacagcagggtaataagtgtgaaacacacgattgcggctgtaagtctgatagtacgcaacataaatttattagattttcaatttatagtagttatatcttaattattttcaattccatcagaatcgaatcttatgctttttaaccgatgcaaatttaagcagagtgattgatttttgcagtatataaacatttaggataatagaaaacatatttgctatagaaaaagtttgttcattaaatgaattttaaagtgggcgaaaagctgttgcttaacatgagataatgattgaataaatgctgtaccaaaatcaattgcagaatggtatcatatttatgttgattctcattcctattggttttacctgttccagaaaaagaaaaatccctgaattttgaaaaaaatcagggattaatattgtcttgctttttaaaaggtggtgccaccaggaatcgaacatttaaagttctttgtttttaaagtcctgatagacagcactaaatcttatatcgttaaaatcaaaaccattgaattagccatatttctaatttcaactatttcaatctttatcgctgttatttttttgacggtgcaaagatatggaaaaggttcgattcctccaaatagtattggcataaaattacagaaaactttataatgtattcatttatgctggaatgaatggcatatatatgaagagaacgtctttaggaaaatttccgaagacgttctcttctatactgccggcttttaaaaagcttccagcctgttttcatccagcagttttataatatccttctctttataaagtatcctgcctcccagccggtaataggggataagcccggttgtcctgtgttcaaccagtgtccggcgtgttatcttcagtgattcggacagttcagcttcggtgatgtacctgtcaccgttcaggataggtctgtatctgtccggttcgcttcttaagagttcagtgatgtgtccaatgtcctgaaagaaccggataatttccggactttcccttgtcagtaagtcatgtgccatatttctttgtttaattgtttcctttttgtaacactccttccatgtatgtgacgatgtcttttttccggtaatagattttcctgtctatcctgctgtacgggatttttcccgtgctgcgcaaagtaagcaacttccttggagagatatccatcataatgcatgcttcctgattatccatccattccgtcagtctttcctcctgccgtattcctcttcctgtccggatatcccggatgattgagcttaacgcctgcttcatttcttcaaatgttgcggcttcgatactgatcacttccataagcttttgattttttgtccgatgtaaaggtatactgccggcatgtttgtctccaagtctctgactacaggtgtcagcagatgtcgtcagatttcacggatagctggtcgagttgtaagtcgtatttacaaattgtacccggactttacaacatccgggattacattttacagtgctttttgtaattttttattttatatttctttgtgaattagaatgttatgtaaaaagatggattcgtttttttgaatccggcatgtaattttcattatagtgtaatatactcttgtaatgcgcacaggaagagtattcaggtaatcactttttaaaacaatggaggatatgccatgatgtatatagataatgaggtacttgagaaaatgatcatgactatggtggaaggttttaatcgccttgaaaagaaacttgaccgtatgaaccgcctgaaagactgcctggacggcgacaccttgctggataactgtgaccttgcgcaacttctgggcgtgacgcaacggaccattgcccgttaccgtgaaaaggggcttatccgctactaccagacggacgagaacgggaagaatttttatcgtagttcggaaatacaggattttttgcggcataggggaaagaaaaaataggttcaattatttatatttgcgggaacctgttatatttttgcagcttaaggattcggtatgaaaaaagaaaaagatttgtctgtcgcggttttgattgacggcgataatgcttcttccgagaagatggaagatgtgatgcggttcgtatcccgctatggtgctgccgttgtgagacgtatatatggtgactggactaaaaaatccctttccggttggaaggatgcggcaagggattattcgttcaggatggtgcaggcttcctcttttgtgccgggaaagaatacgacggatatcgcgttggttatggatgcgatggacatccttcatgaggggcgggtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttctattggctgaccggaaggaggagaagccttttcaggaaaatacacctgaattttttattcaaagagatatggaatactttgataaggcttttgaacaggctgctgacggtaaggcggaggtcagcttgtctttgattggaggggtgctgaagaagctgatgcccaaattcaaagtgaaaaggtatggctgcaggacgctcggcaaattgtatgaaaggcttgagaaatacgaactggttaaaacggggaagggtgttgccggattagtgcggattaaatcctgaatccggttccggttttatacggattgaaaaaaaataccgatgcttcccttgccgcagcaactgttggcggcaagggcggctgtctgtttcacatggcttataccggtatcggattaacccggagtgtgtccagattgatatatgctccccggtacagggttcttccttccttgaacatcctccataggatgtcacagccgacttgtgccagtatggagttgatgtacaggtcctgtctttccagtgcttccgccagtgagcagctcggttcggagtccttctcttctattgtggaatagttcacctcctcggtgatgacgttcattccgggtaccggcatgaattcttttgatgccggctgccgtatcttgttgcggacagtacctatgaagacttgcccggtggtttgcgcattcccgaaatccatccagtaataaaccgccctttcattgtttacggaggtctccctgtattttttcaggaatctccacagttccagtcgtgagcgggtattgtcggtgcaggtgatgatgatatttgccggctttgtcctgtcatctccgttttcctgtgttttccgtacgggatagcggcagttttccgccgtccatgttgttccgaaaaaacggttgacgcgtgtgacggccgccgtcgccttgccttgccctagttccatctcactgaagagctggcgtcctatgttggcttccgtaataatgtcgggatcgaatacggtgacatgtaggcccgggtgtcccagtgcctgcaacgcgacgttcatgcgtgccaaattggttatgacctgtgatcccgtgccccctgcacccgcaacatggatggtgacgggatggtagggtttcagcaggtagttgtccgtgtaatgaatctttttcatgccagtatgtctttaagtttcttcccggattgttgtaactcgctgtaatcaaacggattgttccgtgcatgttccgttacggaaaccaggttgctgcgggtcgggttcctgttacctcccaaatgtgagaactcgctcatccagaaacgcttttcccagtattcctgaaattccagaaaatccatgtcctgcggtttctttggcgatgagctgcccaggcagacgttcgccccggctacattgaagaacggcgccagatacagttctgtccgctcttcggggattgctcccttgaaggcgtgtatgtccatgcattccctttccaccacgtagatgacgcccggtacgttgaatgtcccgtctgtaatgtgcagcccgtcctgaaagtacatttttctcttctgtggcggattgtaccatatgtacctttcgcgcccttttctagagtcgcacaggagcatgttcccggggatgcgtccgtgcgggattccgctcatgctttccgtgtatgattccaccagtgagttcatgaactcataggttaccggaatgccggcccccatccgtcctttctcattgacgggcctgagttcgagataacttcgcggggttgagtaacctgtcgtttcgcattcataggcgacaagtaccgctctgggatgcatgatttgctgcatctgttttgtcagttcattcattttcctgttttattagaagttgtttgtaatgagttttgtgaagcgttcgagccaatgggagaaccgctccggaaagtcatccatggagaaaggcttttccgtgtccggtgtcaggtggaatgtcgtgacgggtgtgatcacatatgattcctggtagtccgagttgaaatagctttccatttcgtcgttcatggcgtcctttaccgaccaggtgaccattatctgcgtatccagtcccaccggcctgaaatctgctgccttctcgtatgcccagtcgtaggagtattgcatgatgctcgggctgccgtatgaaatgtatgccgtaccttccgtgagcagttccagcaatgcccgctcattgttcttcttcgtatggtatttccgtatttccccctccagatccgcaagaaatccctttggattgtccattctcttcagtatacggtgcgccttccctttttcatacagtctggcaagtgcggccttgcgtctgatctctcctgccgtcgcctcttcgtcgtagagcctgtagtcttccaggtaatcgtgtgccatttcgtggtagctggtatccgtgcttttgggtatgccatggtgccgggcgagctgccggataaattccagtgctatctttccgagtttctccggcagtctctccgtgaattccagcggtatccagaacagtttatattccggccactcatggaaccggtagaggcagaagtacagccttccgttctcctcttccaggttgacatgctccgggagtatggtgtccattgcccggtacagtttgacgatgttcatcctcggtgatttcccggtcggacggaaaggaagcctgaggccgacaagtgcgctgtatctgagtgccgatcggtacaggaaatcaaaattctcccttgtcgtaagattgattttctctcccgcgcggatctccatacagtaatcgggggtaacggggagaattctccccgttagaaaatcattacggttcctgccggcggcagccttcttttctttctgctgccggttccccggctgatgtctgtgcatccggcctcgctgataataagtcgtgccaggtcttccgtttgtagttccgataactgtctgcatgttgtctcctcctttttcttagggtttgttttctttgccatggcttatcctttcgttcctatggtggttttgaaccggtatatcgcgcggtcctcttcgagttccggcccgtgcagggttgccgtggtcagttccggatagttcatggaatagaagtccgtcacttcggaaagggacattctgctgtccggatcttccagtgtcagggtgtcatttccttttttcaggatgaatactcttttgagtcctttgatatcaagtgccatattatttaaagttttaatggtttaacaacatataagctccgcctgtgtctcgtccttcatgcggcattcctgcgggaagtctatgtattccgcatacgggtcttcacgcaacagttccctgtcactttcatcgtccttgtcaaaagtgagcgcttctgcggccggttgtggcggtgactggtattccctgcccgtattttcccgggttgtctgtatgacggttgcctgcggctgcagggggacgggttgcggctgttgccatggttgtgtctgtgggtactgtccgccgggctggaggaagtatgtttggggctgttccgctgtttgttgcggactgccgtttgcgggattccggcagtatccttcgtacattggctgtggttgcggtgttcccggataatattgtggtacgggctgcggctgtactatctgcggccggggcaccggttgttgtaccggttgcgggattgcctgctgtacaggctgttgtggcggttgtgacgtgaacatccgcatttgtccgtcaggtcggttaccgttcgccgtaccgtttgcgggcggctgttgtggaagcggctgtgtgtccgtttcaggaaacaggcagccctgtgacgactccttctgcacttcctgtatccttgcctctatctgtttctgcctgtccgtatctgcgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggttccggccgccttgccttgtgttgcggcgagccgtgcctgttgctcgaaggtttcaaggttggtgaggattccctgcgctttctgcagcggtgtggtgatgatctgcaggaattgtccgtccagttccatgggggtgccgttgagtatgagcggcacgatggcctgtccggcttcatccttgagtgttgtacgtttgggtattaccgctacggacagttttccgtccgttctcctgatgttgatgttcaggtctgtgcctgccgacatcatctgataaattgattggaaaaacataatggttgttttttattgttatacataggtttccttgagatatgtcttcagaatttcgtctctgtccggtcgcttcgtgatgtcaagcagtggcttgagataatacccgatatttctgggctcatcaatcgtattgggaaatcttctctttgcaggcctgatgcttcgcgttgtcggccacagtgcgggtgcgaccggagctgacggggtgaattttcttgtttccatttcatttgtagtttaagggtttataataacattccgataaggatcagaatggtgagaattgtcgccaggaacgggaggagttttagcaaaatacggattatgctttccgctattgtcagtaacaggatggtatgtaccggaattatgcctttgcggcatagcaggattattactgcggctgccagcagtgtgaccgccggcttgcagatgcttgcgatggatttctgtttcatgtccttgttgtttttatgagtgtatgattatctcttcgggatctgttttcccgattttacaggtctccttcccccggattgcccttttgtgtcaaggcttggcgaaagaaaataccggagcacagcgaggatgattttctttcagccgaccggcccgcagggctgccttgacacgaatacggggtaatccggtacctttgccgcctaaaagcggcataacagatgtctgataaataaaaaatgcagacttttcagcctgcatttcccgttcctatatatagcttctatctttcacatttccggaagatatcttccgttacctctctcgagagtttgagtacccctttcatgaattcttcctgtgtaagctttcccctttccattcgtgccagttgcgcctcccagcccgaagtcagtgcggtttccgctattttcatgttccgtaccgtctcatatatgtaaagcccctttcgtgtggggatgatgtatttgcctgaataacgtacatatttgcggtcaatcagggtctgcaggattcctgtacgcgtggccgccgttcccagtccggcagtgtccatgtaggtgatcagttccgcgtcggtatatgcggatacggtcaggtccttcctgtgtatcaggctgcatccggtaacagcggccgtctccccgttttccagttgcgggatgggggagaagccgtattcccttcctgcaatgacgctttctctttcgaatatgccgaaccatcccttttcaatgatgcggcaggcatgacaccggaaatttcgtgcggcacatacggcatccacagtggtgtattccgccctgcatacgggcatgaaggcttccagcatccgtccgataatcatcatgtacagctgcatctcttcccggtttaatccttccggatatgtatcggtaatgatgatggcgtggtgttccgccgcttgtccttcgtcgactaccttgtccggcaggtcgaatatgttgatccccatgcttctgacatacggtcggaattccttcctgttcaggattttctccatgatacggggcagtttgtcgtaaacgtcccgtggaaggaaacgtccggcagttcgcggataggaaatcagtttcttctcataaagtttctgtgcgatttcaagcgattttccggcagtcattccgtaatagttgttggcgtctttctggagttcggtcaggttgtagagggctggaggctctatctccctgacctgtctgctgacagcggtgacgcgtgcatgtccggccagtttgcagtcactgtaaagccgtgcagccgcctcccggtctgtgaattcttccgtacagcgcattttgagcagggtgttatttttgcacaggctgataaaaaccggaaaggtgtccgtggcaatgtggttctcacgttcacggtaacggctgcttatggctgccagtatgggtgtctgcacccgtcccagtgagttgtttcccgttccggtcgcctggcagagggcatagctggcgttgagtcccagtacccagtccgctttgttgcggctgtccgctgccagaaacatgtggtcatacaggctgccgggcctgaggttgtccattccttccagcacggcttcgtccgtaagtgacgagatccatagacggcggtaggatttcctgcattccagataccggtaaaggtacctgaacaccatttccccctcccgggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcggtggccgcaatgatactttcgcaggcgtcgaatactttttcgatcactttcagctggaggaccgcgttgatgtccggtatccatcccgtatcggtcttgatgtgttttaccatcagtctgaagggggcgggatttatcgggaagtccccgcgttccgggcggtccatcccgtaatccttcggcatggccagtgaaagcatgttgccgaaggtccatgtcaccatgtacccgttcccgctcatgtatccgtcctctctggtatgtgctcccagaattcttgctatctcttttcccacattgggcttgtctgtcaatatcgcaatcatgatctttttccatttgatgttccccgtaccttcgcaataaaaccggtacggggaaattgtgtatacttttgattctgtctgtatggggcagggattatccgccggcttcgctttccgcttcgggactgatcccgttgatttccattaccggctttccgtccgtccccaccgtgatcctgagggtggcgtccattgttaagcggagtgcggaagtgcggattttcaatgggacggtttccgtttcctccccttgcaggagcagttccatgtccccgcttttttccagttcttctttgtggataccgatggtctccagttctttccagtcaaggtcttcctttctgaatatccggttgtcattctgattcatgcctttttttctgatgaatggttaatgattcttttttgtattctttttatacggcctgtctgcttcctttcttctgttcctgctgccggttttgcgtgtcgtccgcctgtgcggcacgccgggctgtattgcggcgtatgtccgggttttcctggaagtattgcagctgtccggaatttgcgttcactttcaggtaggaactgaatgtcttgttgttggcgcttttcaggtccgatacgagtatggcttttccgtcctgcaggttggcccgttcctgtgccgtgaatacatgcccgtatacttccgccggaacgaccggcacctggcgctcgctgaaaccgtccggtgtacgcgagtattgcggcctgcccgtattcatgtccagtttgacgaaggaggagaactcttcccctttgcggttgatcatgttttcaaggaagacgggttgtcccttgcgcagcgcctccttgtcctcgggagtcagtagcacgttgcagatttccttcgggatgtatatttccccgttctccggattatgtcgtgtatattgcggtcggccggtcaccttgtccagcgtgacgaaagaggagaacagcgctccgtcggtgcgtttcatatcctctacaaggatggtatgtccttcgctgagcattttgatctggttgggtgaaagttgtacgcctcccaggctctgctggttgaaccccttgctttccggatagatgaattccagccccctgcgttccgcgctgtattggagtgtggcgtcgaacggctttccgttttttgagatcattccgtccacatataccggttgtccttccttcagcgcgtttatttcatccgctgtcagcctgatgcctttcacttcacttggtatgtatacgttttcttgccgtacggcaaccagctcgttggtattcttgtcaatggagatgagacagggtgtataggaacccccgttcaggttcagttccgccacgcgtcccatgtttcctgtctcacggaggttcttcttgtcctcttccgtgaagatgtgcccgaaatagggcctttccagttccggttccttgcggataccgtggatacccagaccgatctgcccgtccggcatggtgatgaatgagaggcgtgcgtccagtttgaccctggcacctgtcagcgtcagtgtcaggggaaccagtttgttggttttgtatcctttcagcatggaatccagcagtccctgctgttcgagggaagttttggagactcccatcttttccagtgcgtcccagtttaccatgttctcgtcataacggtagcgtggtgcctgctgttcctgcggctgttctgttgaaactgtcggttgtggtgcctgttcctgtgggtttgttttttgtttctttgccattgtttctgtttctttttcgttcttactctgttccttgttttctcttggtcggatttcgtagcgtttgaggaactcttttactgcgtccgtttccttgccttgtgacaaatccctgattgcctgcttgttctgcttgtaatcatggacggtcattcgtatgagccggaaatgtgtaggttccttgaactggctccagaagttcttgatgaagttttcgaggatactggagtttttctcgaatttcagaaaggagttttcgttcttttcttctgcaggaaccgtcctgacctttccttccccgtcaatttcgctgacggcttgcacaccggctttggggtcctccttgttgtggacaaacagtagttcgttgatttgttccacatagggcttttctttggcggatttctgcgttttgcgcgtccgcttcggtttttctttcacttctttttcttgtgccatgatccatcattttgagattaatgttttcgtttgacagctcaaaaatagtggctgaaattgaataaaatgctgattctcaaaatggtgacatcacgtgtcgttagatgtcagcagatgtcagtcaaaggggaaagatgatggtaagcgtctctgcgatagcatatagcgcatctcaaaaacgacttttacatagatcagtaaaaaacgaattatgataatagaaaattctgatccggttcccttaaaatatcttacgttattggaagttcctaaaaagagctgacgcagaatcctaaaaagtctttggtatcattctgtgaaaaacattcaataaatgatcatttcaacagatggttttgccccctcagaatagactatgtaatgaagtatgcctggaggctggccagtctccaaattcaaatgaattgtacttaaacagctccgaattattgaagactgaactgaataatgatattaatctatgtctcgttgatttttgtgaaaggcacaatatcgattataggggaatggtgaataggctagtaactaacaatatgtattttttctatatatggggcaaatatgcgctgtcaaaggcatagagattcccaagggcaacagctaaccttatattcctcctcctttcaacggggacaaggcacaagcaagactcggaaagacactggataaataccgaaaataactggattccaatccatgttattcgctgaaagttcattgcaccagaatgggaataaattattgtgatatgttacgctggatgagattaatgaaggttattgtcagacaattgtaaaaggcgtaagattcaatacgaaaattccccgataatcttccatgttcatggttcagttttggttcaatggaggcccccgctcagatatgtttagaggtgtgactatcagctgtcctgatgggaagagcattcatgtggaggaatgttccgttattgaattgtgtacttctatacacttatgataaagaccaaagacgaaaatatatactcccaattatatttgaactatcagaaaacaaccagtactttttctttccagaacctgtccgcatgagttgtggtattgatggtttttccaaatcggtttatatccatcctatactttcattggtttcaggggatatattcattttttatgttgacaacaaaattatgttggtattgacctataatatctttaaatagaaatactaaagtttttttatcacaacataataatcttgcatgtttcatatctttatgtcaaggaactgccactagcggcagcatcaatcacatgtacgaaagactttatgttacagaatccaagttgcgggtgcatcttgattctccattgctaaaagaacgcagagtatttttagaagaaaatgcgaacatgggtaaatctaaagaccggttacggatattagcgtcctatatttttacgctacgcatgctttgcatttacacgacggggaaaatgatatagttcctattgagaatatcaccaaagtatgccatgattatcggatgcattattcagatcatttccataaagtctgcatagcgagtgaattaaatgaatttacagatgcttttcgcattatttattcatggcttttctctttaaaacttttagagcctaagttcatggataaggattctatcttttgtaggttatttacaagcatccactttaggctaaaatatattgcagctccacattatgaagaaaggaaaaggcatctggagactttggaaaaggatggagtaccgaaggcttacattagagaatatgcagagcaacagcttaatgtcatcaagcagtttaaacttgaacaaaagcctataggacatagcttctccactgatgaaatcattgatgcggcccgttgttttggagagttatcaaatgggatatctgttcgcagtagatatcagcgtttcagagctgtctgtatgagttggttctcattcatggaagttatcacaggaaaagataagagttatcccggctctaactatgtggacatgttctgtgaatggcatctcacctccaaaggaagctctgtcggcgctacggtacatatatgtcaggaattagatagattctttgcttatatcaactcaaaaagcgtaacgatcaacttattgaccgcggcttgtatcgacggatatattgaaacttatcaatccgcatgtttcgcacgtaagactgtggccagtaaggtgtcaattttgaggacttttctcagatatctatataacagaagtatcattaaaacagacatgtcatcatacctcataagcccccgaatttatacatgtgagattctatctgtttctccaaacgagaatgaccttaatcgaatctctcatttttatgatggtaacactccctctgccattagaaataaagctatacttcttttacttatagaatacggaatgagaagtgggggaagttaccggtttaaaacttagcgatatagactgggaacgcgatgttctgtatcttcacagagaaaagggacgccgaaacagcaggtgctgacgttgaaagctaatgttggaaacgccatcctcagatatatcaaagaggtaagatgtaatgaacgtggttatagggaagtttttcttaagttgaacaattccgtgagaccaatgccccccaaaggcatatatcatgtggtttccaatgccattaagggattgtgtatacatgtagagcatgtaggtcctcattctcttagaagagcatttgctacgatacgtatcaataaaggacatacgtttaaagatattgctgacatactcggacacagataacttgacacgaccagaatctacgcaaaggtggaccttaaaagcctgcgccaagtatctgacataaattgggagggtatattatgacagtaaccgaagcaatatcaaagtacatcactttccgtagaagtgtcggtgagaagtttgatacagagcctagaataatgaatctgttctcaaaagctgttggcgaagacagggaaatgtcggacattaacaggcaacagtgcgtgtcttttctatatagcagaccttcattcaagaatggtttgaccgcctattagttcaacatatatgggatgttggatggtttattcaactgggctatagcaagaaacatcatgaattacaatcctcttcccacagataagcccaatcgtccgcagggctttatcccatatatatacaaaagggaagagttgaaaaaaataattgataaatccatgacttacagatccttttatacaaccttttaccctgaaactatcagaggaataataatgctgacctatctttgggggcttagaccgagtgaaactcttggcatagagatggcggatgtacatcttggtactgataactatatagtgattaaacaaatgaagttctataataccaggatagtaacattcaatgataggtcgcttcttttatagaagacttcctgttttggcgtaaacatacaggattaccatccgaggagtgactcacctctgtttttgaaaagaacatttgccgcatactcaacacatgctctacaaatggcctttgccatgatacgtgaggatgcaaatgttcgtagatatgatggcgcaagataccagccaagactgcacaccgcgcaccacacatttgctacagagagaattgtgtcatggtatagggaaggacgaaacgtgcaggatatgcttcctgtcctatccacctaccttggtcatacgagcataaatacggctgtctatgtgtctatgaccaatgaattattgaaggaagcaggtcgcaagtttgaatcatgtgtattgaaattatgaacaagcaagaaaaatactcatttgtaggttactggttcatgagatatctatctgaatatataccggtaataaagaatcaatctcataatacgctcaccagttatcgtgactactatatgcagtatctaccttttgtagccaagagaaccggcaaacatgccgataaacttttgattacggatctcactgtcgagaggaccaatgcttttttgaatcatatagagacagacaagggctgtactattcaaacccgtaaccaaaggcttaccgcaatcaagtctttcgtccattatgtgtacaataatgcacctgaatatatggaatggagccgattgatgagcactataccgatgaagaaagtgaaggtaaaagtcattgaagggagcgtattgccagccgtgtcttatcttgacaagagagagatggatgcgttgcttaatactcctgaccgacaaacagtacaaggcaggaaagattatgcaatgttacttttcttgtataacactggagttcgagcctctgaggcggcttcgctaacaataggtagcattatttatgatgatgcttcgtgtccgttggtaagaatttatggtaaggggaataaaagccgcacatgccccttatggaatagaacattaaacgctataaaaccatttatggccggcagacgtgaaacagaaagagtcttcttgaacagatacggaaatcccatgaccagattcggtatttacgaattactggaaaggaatgtcataaaggctacggccactgcaccaactcttgcaaagaaaagagtgagtcctcatactcttagacatacagcagcatgtcatttatatgaatctggaaatgatatcgttaccatccagtcctggttaggccatgtctcattaaatactaccaatatatatacagaggtaagtttacaaatgaaagaaaaggctattatgctatggactatagatggtgaagaaaatgctaccaagtaatggaagaagaataaaggcatactcaacttccttaactcgctctagcctaaaaaatatgttggtatcaaattatataatctgtttaatgtcagatatatacattatagtaccagcataattttgttgccaacataaaaaatgttatgtggtataccacgtaatgtgtggagtgcatacaagagccagtccattccaggatatattacctttaagaatggactggatagattttatacacagtttgaactgtatgagttaatcagctaagacttgtgtataaagggtagcttcccgaaggaggagagttgtgatagaaccgactttttagtcagcctcttttcagcctgttattttaatctatacttgttattttaatctataaatgaaatagtcaggctagttcttctatggctgtaaaagcctgcttttaaagtttacgtatttctgcgtccaaggacaatgcacaagacatttcaaacaggtactgcatccatatacatcaattatatcatctcttgagattgttatattccaggtggttcctttcaatacttttctttcgcatatatccctacaaatattacaattaccacacttcggggaaataggggcatacggtacagtttctaacggtgcatcagttaaaacagtaccaagacattgcgctgcaccatattcaggagtaataaacagattgtttttcccaatccatcctaatccactaagttgcgctactgttttgtgaggtaaaaccgactccttcgtttcaaaattaaacacaccttctgccaaaagtcccgcatcagattgtgaaagagctttataccctttgctgacaagaaattcagctaactcgtctgttacttctcccactctattttcagtttttacatactcatcttcaagaacaggtttataatcaggattattaaatacatcttttacaaacttcggatttattgcgattcctattaatatagcacatggcaaacctctattctgcttattggtcaacttggatatatctacgaaatgaacaaaatctacccttgactttttcaattcattctctacttctttattcatatttctttctttttgacagggatataaatatctgtgattagttccgaaaccggagttttttcgggtgtattgatataagtctcaaaagtaaatggttctcgcaagctataatcatttgcaggtagccaatcaagataaatataacgatataccctattcagttcatgatatagtcctttaaaacgaaatatagcatattcacccgcaggaacttcataaacaccgaaccccttcggaattttaaatgattgtggtaatgttactccaaccataaaacgactttgttcttcaagcgtgataaaaggataatcaagagtcaggcttacatatttacatccttttgataataatccatagctttcagaaaattgtagcacctgtttccataaaactgaaaaactatggctgacatgatgtgttctctctaattttaaatatgcaatccgtgtatgaggcactctttcaatacttggttcaatctgtattggattcttaccttcagaacaggcatttgaatgtcttttacgaaattcaggtatagagcaattaaaatagtttttgaatgcccttgaaagagtatgtttattctgataattgatttgactaagaatttcggagacacttacattggtggatattaacttaaaagcaatgtactccaatcttaatcgttggatgtaattcccaaggctatcaccgcaaacagctttaaaaagtcggcggaaatgatacttggaaatgcatacaatttgggataacttttcagaatcaaggtcatcaaataaatgacaattgatatattcttgaactctgatcaccaattcatattgtatgtgagcggtattaattttttgcttccatcttttaatttcaggtaaccgtctggacataatttctctcaactccgacgaagtatggcgtatgccgacctctttatagtattcttcgggaaaaagtccccaaaggtagataagataatccattgagaagtcatacagtttaactccatttttcagacagtaatcacaatattcctcattttggtccgccttcagattggtataatcaatatccaaaggtatcccgcaagtctggcaatattttgtttcagaattgatgttcataagttttttattattgagtgcaaagttaaccaatatgttatgcaaaaagttaccagaaatagccttctttcgctttaatttgctttttattggttctacacatctcccccatgtaatttgaatgcgtttttgctctcatgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaatttgcctgtatccctttattcatcgttgtttcaggtatggtagcaagtgtggtagcaggtatgagagcaaacgtttgctctcatacctgtcttgtatctatgttgtcaattccatcctgattcttctcatgcaaactgcaatttccaattcaaaatcacggttgtttcagatagtttcaagcgcttggaactctagtttcaagcattgaaaccattagttccaagccttgaaacaaaagtttcagacgcttgaaactatctgaaactactgtcgattgggattacttgaccgcacgatctgattgacttaaccgtatcaactgttccgattcacctgttctttcaagtagcactaaatcatctattgttcaataatacatcatttatcaggtattaatacctgatttctcaattattaatacctgagatgtcaatcgttaatagttgacaaatcaaccattaacatcctacaaatcaaaagatagcattgaataaacacttactaacacgatttgacagagtgagagcaaccgcttgctctcatacttgccaccacgcctgctatcatagccaaaactacgatgaataaagggatacaagcgaattgttagagcgtgagagcaaaactgctattaaatcactgtggagaaaatccagaatcaacctattctcaaccatccgacttctctagttccaatcgtaattcttttaatgccatgatttccatagtattctgaacatatatgcgtgtcaacaccaaacgagtcataacacgacttgaacaaacatattcatcatctacgaactcatcaatgaggacatcaaggaagcagagagtacatttaagttcatgttttgatagtttatcaatgctttcaatttgtccaaagctaggccaattgtctttaagaaaggcaagtttgtcggtggagtcctgtaaatcaagcttcatcaggcaggggtaggaacaagtaggatcatccataattttctgttttttcatttgtgtgttcccgtatgccccaaagaaaaaaggcgtggaaactattactacattaccctctcaaaggctctggtaagcccgtattcgaataataagtaatagctccacgcccatgaggtatataacaaacttatatacaacaaagacgtggagaccggttacttattatctgcgaatactaaatttaccagatttatgagagcagataataaaaacgctatctccaaaataaaaaaagcgtagctcctttgcggagatacgccacaaatatagttatattttctgatattgatactttggtgtgtactatttcgccatctgattcagacgaaataccgccatatcgctgtttgttccgtttcaataatcagatcgataaacatataacaagttaagaagagaaaagagttacagagtctgaatagtctaatttattcttttagtaattcatcgtctaaaatatctttcataatacgattccttcattagtgacattaatataaaaaggtgttttgaacggacggttttcccaaagttttttcagcataaccatcggactgatagatataccggttttcagttcaagttcgtaaaggggtaaagtaatcgcctcttcctctttcaaagttattttctctccatcaagcaagatgagtaaatcaatatcactgtcactgcgtgcctcattcctcgcttgagaaccatataatatggtcttagcggtaggagcaacatgacggataatgtccttgatttgttcgatcacttctgttcgtctcataacttcttaatctattgattatatgcaaatatactcgattcttttcaattctcaacacacccaagaacgctttttattatattctcactatttcgccatctgattcagatgaaataccgccatatcgctgtttgttcctattctgaaaggaggcccccaaagagataatccgctggaaacatagatatgtgattggctccatttgcgatagccgtgactctgttcatatattctgtctgttacccaacttataggccatatctgtccatgatgcgtatgtccgctgaattgcaggtctattcccaaagaatctgttttagccaggttgtagggttgatgatctaaaagaatgataggtttactacgatccgcttgctttaataaggtaggcagggaatgacgagaacggttggaacggtcgtcacgtccgatgatctgcacaccgttaggcaatgttactacggaatcacgcaatagttgtatgggagtatctttcaagaagcggacgctttcatcaataccgctgatgtattcatgatttcccggaaccatataaatgcccaagggagctttcagttgtgccagttcttccgccatattctccttatataatggggtaagactattatctatcaaatctccaccgatcagtataaggtcgggatgctgcgcatttatcatatctacatattctttcagcatggcttttcccgtaccataccctaaatggacgtcactcacggctacgatattgattccgttaccttctatcggcttatcaagggagacatcaatcttattgacctgcggatgacggtagttataataaccgtacagaagcagacagcaagtcgctcccagcgcataatagaaaccgtgatttagtgacggcacaaatatcttcgtcacatctgctatcaacaaagcaaaaatcatgtacagtgtaaataccagccataccgaaccgatgtgaaacatggatttcgacaggatgacaggcatatctatatgacgggtcagcatagctatcaccaacgagaaagctaccagccaatagatgacagacaacagaatcttcatagccagcgagaagccggaaagcatctgtaatgtacggataaagatataaacattgccacctacataagcaagcagaaatatcaggaagaatattcgcataatcgttataaattaaaatggttatcaaatatattatcgcccttttccgttgtcaggtagtgagtgtctgtatatctttgtgaagaataaaaaacaggtattatgttaccggatttgtgtaaagcattcgacaatacttctacctattgttgacagcttgttccaattgcctcaaagccttctccagcgtagcacgcggacaggcaacattcaaccgcataaacccttcaccttctttgccgaacgtcgttccttcattcaaagccaagtgggcatcttctacaaacaggcgattcagttcctcctgatttaaccccagctcacgacagtctaaaaagattaggtaggatgcttgcggacgaatcattctgatggcaggaatccgctctttcagataactttccgtgaagtcaatatttcctttgatataggcaacgacctgatccagccattcagtaccatgactgtaggctgccgctacgctgagataagcgaataagtgtccttcggagaactcgctcgcttccatatatacctggaactgatgacgaagttcgtcattctcaatgattgcatacgaacttgccagtccgggcatattgaacgctttgctcggagacataaagacaagggagttcatccgtgctttctcagaaatcaaagcaaaagtaggatgcttgtaaggaggcagggtcaagtcggcatgaatctcgtcagagattactaatgtaccgttctcatagcagatgtcagcgatctgcgacagttcttctttggtccatacacgtccgcccggattatggggattgctcagaataagcagcttgcatccctgcacatctttgcggaaacggtcgaaatcaatatgatattgtccgtctttcaataccagcggactgtacaccacttcacgttcgttcttctgcgtcacgagaaagaaaggatggtatacaggaggcatgaccatcaccttatcccctttctccgtgaaacaatggatagcaaatgccagtccgcggacaatgccgggagtaaacgtcagcatatcctcgcgaatctcccagccatgccgttctttcagccagttgataatggattcggcccattctttgcaggcaaatgtatagcccagcacttcatggtccagacgtttcttcaaggcgtcgattacaaaaggggctgtgcggaaatccatatcagccacccacatcggaatcaagtcattacgcccccaacggcgttctacggcatcccattttacggagtccgtaccattacggtttattatttcatcaaaattatagttcatactgcatgaggtttttatgtatcttgaagcaaaagtacacaaaaactccgagtttgtatcttaaaactctgtaacagacgttttcaagccgattcttttaatatataccggcactctattccttttttttctgcctgctcctataggctgtcggagtttctccggtatattgtttaaatgctgtactgaaataactgatagtagtaaatcctactttctctgaaatatccgtaaatgtaaaatctgtagcagtaatcagcagaatcgccttttccatcctgattttattaatatattcatttagaccaatgcctgtcagtgccttcaatttcgtataaagcgaagcacgactcatccctacctccttacaaatgaaagacacatccagtttcgtatcactcaaattctcctgaatgattctattcaatttcaccaaaaacgtttcatctgccaaactgaaagtagtttcctccggagctggtattaatccagcatccaggtatctcttctttgtatattcacgatttttcaaacgatttcggattaactccatcaacatttctatttcgaaaggtttagtaaggtagccatccgctccatttttataaccgctaatctgactttccttatcatctctagccgtcaacaaaataatagggatatgactgacagcaaggtcttctttaagacctttacaaagttcatatccattcattcgtggcatcatcacatcactgacaataatgtctggtgtataactctttaccaactgaagcgcctccactccatcagaagctatcaacacctttttaaaatattcactcaatgccttactaaaaaagtccgtcagatccgaattatcatccacaaccaaaatcgtatacgaagttgtatcaaattcctctcctttactgatatgttcactatcatcgttgctcatcaactcattcaaataagctttcggttgacaaacaatctcttcagcatcctgcctcaacggcagttcgaagaaaaatgtggcacctgtttcctgattatcccgggcaccaatggagccgccatgcaattcaaccaatattttagaatatgacaacccgattcctgtcccgttttgttctttagtgccctgataaaatcgggtaaagagctttcgtgtatccacattttccaatccgcttccctgatcaatgacagatacgcgcactctttttctttcagaaatcaattccgaaacaatagttatctctgtatgttgcggactgtgtttcaaggcattaatcagcaaattgcttagaataatctcacacttgtttttatcaaaactgactgcttctattcgtgaatcaaaccgataactgatatgtacactttttgcctctccctcgctgataaagtcttgtgatacatgcttgatccattcgtttagcggctgtggttctatttgtaaccgactttcacctacctccattttacgtacatcaagcaccatatttatcagatttttcatccgctgtgactgtcgataaatagcctttatcggcaaatattgggcatcttgaggagaaagcgatttcaatatttgcttgagaggtgcatagatcagtgtcaaaggtgtgcgcaactcatgacttatattaatcaaaaaacgaactttttcttcatacgttttttgctcgtgttccttcatttcccatcgtagcttttcctccttacgtttcaacacttttcgcacactttcaatgacaatgacagctaccaatagaatacaacccaatataaaccaccatgtcttataccatggaggagaaattgtcagttgtaacaattgttgagcaggcacccaactaccgtctttagtggtacaagaagccataatctgataattacccggaggaagcgcacgcatagtcagttccggactatatgattcaacaagctgctcatccagcccttttatctgataccgatacaccttctgtctgaagatatcttcttctttcgccatgacatgaatgacaatattactattccatggcacggaaagctttcttataccatcatacaatttattgttcgcaggttctccattgattatgatatctgataattgtaattgcggattcgtatttctcaatggtagcttaccatcaatatgaagcaatcctttgacccctcccatataaatatcacccttctgacttaacaaacgagcttctggaaagtattcattcggaacagctccatccgtttcgccgaataatgccatcttctcctcggctatggaccatgcaaacagtcggttttcagcaccaacccaaatctttcctttttgatcacaaatcaatgaagaaacctctataaataatgaagtagaaatcattttttgtttctgtgtcgctggatgataactcaccaaacctaaattactcccgatccaaaaacagccactctcatccatggatactgaatttatattcatatcatcctgagcagtaaacaacactctcagcttattactatgattatccaactcataaatatgttttatatcgttcaaataagttgaatgcccatcacaagcaattgctttcaaggacccctcaataatatttatgcctttttcttcggaaacaatagaaaactgcttctccttcaaatgataacaatacacgtgattgcccaacagcaatatcgtgttgggagtattccgataaacattgaccgtatttccgtgaagacataaacgttcattgacttctttatcaataatagtaaatggttgtttatttcctgtgaccggatcaaaaataaatatcccttgtgcaaatatagacaacaataatttcccggaagcaaagccacaaatagaagcaactttatctcccaaagtagaaggataatgtgtaaactctccggccagggagttaaaacaattaattccacctccatttgttcccacccagatatgacctgattcctgctgacataaactcaatactatattgtcacttaaaccttgtttattattcggcaacgcatctgtgtatgcctgcatatatacctcacgaacactaatcaaaccactataaatactcccaatccatatattattattttgatcattataaagacagatgattgagttattaggaagtgatgaattgacttttccggggatatgctttaaggaggaaaactgctgagtctcaggattgagtatattaatgcctcccccgtctgtcccaagccatatttgccctttacgttcaacaatactcaatatgatatcattactaagagaggaattacgggttgtataaagtgcaatctgctttccatcacgggtaaaacaacgcagtccgacattataagaagcaacccacactctttgtttggaatcaacaagcatacccgtaatttctttttctgccccaaaaggcgctcgtctgtattcgcctgattgaagatcaaccaaatacatcccttgccaacgactgcaacatagtatcgtatgagaatctatcaaacccaaagcggtaatattaaagttctgctccgatttaaattcgtagattttccgtatacaagattctttataactatagtgatagattttcccttgtccaccgaataaaattccttcaggggtccggcaaacagaataagcaatcaaattttcacctttctcatccgtctgcaaaagaaagtcatcactctgatatcgataaagtgaaattcccttatctgttaatatccaaagattcccctgctctcctctcgcaatctgataaatttgattaccgggaagtgaattagacagggatgagttatggatatattttttaagttcctgtccatcaaatcttcccaagcctgatcttgttcccatccagacgaagccacgattatctgctgcaatgcaatgtacagttgaaggtaatccagcctttaatgagatttgtttgtagtaataatgttctgcccgaagaggatatgaaaagaacatctgtacaatagatactatgagcaatagttttgttgcgttcattatagtcagattataagattcagttttcaaagatactacatttaagagaaaatattaccagaaaaagagaaaaagtatcttctgctctatctcacaaacactgctatgtcaaaaagaaaacgcatcacacaaaaaagaatactttccattctaacaacttcttatttttactatataacaacagattccccgatgaaatggggctaattagtgatttttgaaaataaattagtgatttttgaaacatactgcaccattcattctcctacttttgcagcacacatcaagttgaataaatactctataatacatatgaaaagatttacactattaaatgacctatcatttttcaatttttacgatttgcattttctctggatacgaaatatgcaaataagaacttaacattaccccaaaaattccactatctagcggcattggtgctggatagtggaaattttctcctaaaaatagcaatttcaattaatactatgacctatgaacaaactactgacctcttttatattattctccattattactttgggaggacaggcgcaaaagaaagaaaactattatgtaaaacacgtagagtttcccttgaatgccactcttgaacaaaaaatcgatatggctgcacgtttggttccaacgcctcaacaagtagtctggcaacaaatggaactgacggctttccttcatttcagtataaacgcctttaccggacgtgaatggggagatggaaaggaagaccccaatctctttaatcctacagaattggatgcagaacaatgggtaagcaacttgaaagaagcaggtttcaaaatggtgattctgacagccaagcaccatgacggtttctgcttatggcctacagctacgaccaagcattccgtagcgtcttccagttggaaaaacggacaaggcgacgtagtaaaagaacttcgaaaggcatgcaaaaaatatggcatgaggtttggactatacctctctccatgggatcgaaatgctgaatgttatggagattcccctcgctataataagttttttatccgccaactaaccgaattgctaactaactatggagaagtacacgaagtgtggtttgacggggcaaacggagaaggtccaaacggaaaaaaacaagtatatgactgggataccgtctatgaaactatccaccggttacaacccaaagcagtaatggcaattatgggagatgatattcgctgggtaggcaacgaaagcggattaggtcgtgaaacagaatggagcaccaccgtgttaactccagagatatatgcccgtgctgacaagaataataagaaattaggaatcaatggacagtcaaatgatttaggaagccgcaagatgttggagaaagcgacagagttattttggtatccctcggaagtagatgtttccatacgcccgggatggttctatcataaagaagaagataataaagtgaagtcattgaaacatctcgcagatatttatttccaatcggtaggatacaattctgtacttctgctgaatataccaccagaccatagaggcttaattcatgaagcagacgtacaacgtctgaaagagtttgctgcttaccgaaaacaagtatttgctgacaactatgtgaagaaagggaaaaaatattggaatacagcttccggcaatgaaaagatatatcaattaaaagccggttcagaaattaatgtagttatgctgcaagaagatataaccaaaggacaacggatagaagcattcaccgtagaagcactgacagataacagctggaaagaagtggctaaagggacaactgtaggttacaaacgattgctacgttttccaactattaaagccgatcagttacggataaagattttagaatctcgtctgaatgctaacatcagccaggtggctgcttattatgcagcacctataaaggaagggaaacaagaggaaaactggaatcagttgcctcgttcaggatggaaagttatgtctacaaagccattaacgatagatttgcaaaagaaggtgacaatcaacgcctttacctatgctcccctaaatgcaaaggcaaagacaacaatggctttccgatataaattttatatcagtctcgacggcaagagttggaaggaagtacctaccaatggagaattcagcaacattatgcacaacccattgcctcaaacggtctatttcaatcaaaaagttcaggcacgctttatcaaactggaagccaccactcccactgatacagccgcaaaagttgaaccaaatgaaatcggagtaacaatagccccttgattttacattcatcacaagtactaactaaaagcaaaaatcagaatagaaaagacgccatctattttgatttttacactatataaatcttcttattatcaaattaactccaatgaaggcaaagaaagagaaattagtcttaatgaagataacagatctttaatatataaggactgtctatccaaacttatcgaaaaatttaattaaccacaagatgtcatatttataaccccttttcaatcctaataaaggaaaaacatcgcaaagatattaattcttaatataattatgtagttagcaggaggtttttatcataatttaatgaaaacccgactctttttctcgccgatacttgatatttcggggatgatgctcgataatctcgctgcgaagcatgtttcggtcgatatgggtataaatttcggtcgtcgcaatcgattcgtggccgagcatgcactggatggcccgtaaattggcgccaccttccagtaaatgagtggcaaaggagtgtcggaaagtgtgcggactgatgtttttggtgatacccgcattttgtgctaattcttttatcatatgaaagatcataatccgggaaagtgatttgcctctccgctggctgacaaacacaaaatcttcatagtcttttttaacttctatccggttgcggtccaagaaataaagtttgatctcgttaatggcacggggggaaatgggaacaagacgttgcttgcttcctttgccttctactttgatgaagccttcatcaaaatagagatcggataatttgaggctgacaagttcggatacacggagtccgcagctgtataatgtttccagaatagctctgttgcgctgtccttcggctttgctgcggtctacggaggagatgatgttgtcgatctcttctacggtcagcacttcggggagttttaatcctatcttgggaccttccagcagttcgctgggatcagcctccagataatccgccataatcaggaaacggaagaaggacttgatgccggataaaatgcgtgcctgagaacgaggatgaatgccgatgtcatgcaatcccgcagcgaaacgctggagatcggacaggcatacttcaagaacatctatcccttccagagtcagaaaactcatcagtttatccagatcggtcagataagcgtccaatgtattgggggataaagacttttccagcttgaggtactgctggtactttctgattatcagtgcttgttgctccttcttcttgtttttttcgttgatttccatttcttttttctacctttgtagcctgaaatattgttctttggatacaaaggtattaaaaaagcaggactacggcgatgagaatacaaattattaatggcccgaacatcaatctgttgggcaaacgtgaaccttccatatacggaagtgttacatttgaagactatctggctgagcttcgtaaaagatatgctgatttggagatcgactattttcaatcgaacattgagggagaaatgattgactgcattcagcaggtaggttttgaggtagacggtatcattctgaatgccggcgcttatacacatacctccatcgctctgcaggatgccattcgttctgtgacttctccggtgatcgaggtacatatttctaatgtacatagccgtgagtctttccggcatgtatctatgatcgcctgcgcatgcaaaggagtgatctgtggcttcgggctgaactcgtatcggttggctctggaggctttgttaggtaataaataaggtattaatatattaaataggtaaaaaggctatgttactgaaacagacaaaaatcgtcgcatccatttcggacagacgttgcgatgtggactttataaaacagctgtttgaagctgggatgaatgtggtacgtatgaatacggctcacgctagccgtgaaggttttgaagcgttgattgccaatgtacgttccgtatccaaccggattgcaatcctcatggataccaaaggaccggaagtacgtacaactgccaatgcggaaccgattccatatcagataggtgataaagtaaagattgtcggcaatcctgatcaggagacgactcgtgaatgtatcgctgtttcgtatcctaactttgtgaacgatttgaatatcggaggtctggttctgattgacgatggtgatcttgaactggaagtaatcgataagacagccgattatctgctttgcgaagtgaaaaacgatgcaacgttgggaagccgcaagagcgtgaacgtcccgggtgttcgtatcaatcttccttcattgacagagaaagaccgtaacaatatactttacgcgattgaaaaggatatcgatttcatcgctcactctttcgtgcgcaaccgtcaggacgtacttgatatccgtgaaattctggatgctcacaatagtgatatccggattattgccaagattgagaatcaggaaggggtggacaacatcgacgagattcttgaagtggcggacggcgtgatggtagcccgtggtgacctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatctactatcgtacggatgctctgatgttgagcggtgagactgcttatggcaaatatccggtagatgcagtcaagacaatgaccaagatcgcggcccaggctgaaaaagataaactggaagagaatgatatccgtatcccgttgaacgaaaacagtaacgatgtaacggccttccttgctaaacaggcagtgaaagctacatcgaaactgaagatacgtgccatcatcacagacagctatagcggacggaccgcccgtaatctggcagctttccgtggtaagttcccggtattggctatctgctataaagaaaagaccatgcgtcatctggcactttcttatggagtggaagcaatctatatgccggagctggccaacggacaggaatattattttgccgctttgcgccgcctgttgaaggaaggacgtttgcagccgactgatatggtaggatatctgagtagcggtaaggcaggtacacaaacttcattcctcgaaatcaatgtcgtggaagatgcgttgaaacatgcgggagaaactgtattgcctaacaacaatcgttatctctaactgttacatctaaaataaggtttttatgcaggagactgaatctattgatgaatatattttgcagcatatcgatgcggaaagtgactatctgaaagcactctaccgggatacgcatgtgaaactgcttcgtccccgtatggcttccgggcatttacaggggcggatgctgaaaatgtttgtggagatgattcgcccccggcatatactggagatcggaacatatagcggttattctgccctttgtctggcggaaggcttgtcggagggcggaatgttgcatacgtttgaaattaatgatgaacaagaggactttacccgtccctggctggagaattctccttttgcggacaagattcgcttttatataggagatgccttggagcttgttcctcatttgggcgttacgttcgatctggccttcattgacggtgataaacgtaaatatatcgattattacgagatggttttaaagcatctttccacaggtgggtatatcattgccgacaatacattgtgggatggtcatgtgttggaacaacctcgtagtgcggatacgcagaccattggcatcaaagcattcaatgacgcccttgtgacggacgaccgggtggagaaagtaatcctgcctttgcgtgatgggttaactataataagaaaaaagtaagataaggagtaaatttatggaaacaaccagacagaataagatatcccgcctgttacagaaggagctgagcgagatattcctgcttcagacaaaggcaatgccgggtatattaatatcggtcagcgcagttcgtatcagtcctgatatgagtattgcgcgcgtgtacctgagcgttttcccgtcagagaaagcagaagaaatggtgaagaatatcaatgagaacatgaagtccattcgctttgagctcggaacccgtgtgcgtcatcaattacggattattcccgaattgaagttcttcgtggacgactcactggattatattgagaagattgattctttgctgaagtgaattttcccttctacatagctcggcgttatcttttctcgaaaaagaagcataatgctatcaatattatttccggcatatcagtatgcggggtggcacttgctacgttggcactggtctgcacgctttccgtattcaacggatttcaggatatggtagccagctttttcacagcttttgatcctcagttgaagattaccatccgcgagggaaaagtcttcgacggacaggatgaaaggattcgtgcggtctgtgcgcttccggaggtctcggtatctacagagacgctggaagagaatgcgatggtgcaatataaagaccgtcaggctatggttgtgttgaaaggcgtggaagataactttgaggatttaaccgaaatagataacattctttacggagccggcgagtttattcttcatgattcgatagtgaattatggggtgatgggcgtggaactggtttcgactttgggtaccggactggcgttcgtagatcctttgcaggtgtatcttcccaagcgtaatgccaaagtgaatatggcgaatcccggggcttctttcaatcgcgactatctttattcaccgggtgttgtgttcgtggtcaaccaacagaagtatgatgaaagctatattctcacttcccttgatttccttcgtaacttattggactatacgacagaggtttctggcattgagttgaaactgaaaccgaataccaatatatcatccgtacagtctaaaatagaaaaaatgctgggtgatgactttgtggtacagaaccgttatcagcagcaagcagatgttttccgtatcatggaaatagagaagctgatctcttatctgtttcttacttttattctgatgattgcctgttttaatgtgatcggttctctttctatgttgattctggataagaaagacgatgtcataaccttgcgcagtttgggagccagtgataaactgatatcccgtatctttttatttgagggacggctcatctctctctttggtgctatctccggtattatactggggttgatattatgttttattcagcagaagtttggcatcattacccttggcggaggtggtggaacttttgtggtggacgcttatccggtaagtgtccatgcatgggatgtagtgcttatttttattactgttttagcagtgggattcctgtcagtatggtatccagtgcgttacttaagcaagcggcttctgtaattggctgaagaagaaaaaggctataacctttgaatacagaagtgtaggtgctttgtagaggagtttgctaaaatggaacagagtgtttcatgtatttatgtagaaactatataaacaaaaagcgcaggcaggagacgaactcctttacctgcgcttttctattttttctcagtaaaatgaattacttcacttcccaagtatcgttcgtcatcagcaactcctggaaattatgatatttcttcttgcctttgacttcttcaatctgttctgctacagcgtcattgtaggtaggtgcctctacttcacgaatcacaccgagtgcaatcgggaaatcggggccttccatcaaagccagcttcaactgaagagtattgtcctggcaatgagcatcgtgaatcagaatatctttttctgtgatgccattctcgccaagttttaccactttcagtccgaaaccttcctgcatcagtccgaactctttgttttcaccgaacaacatcggtttgccgtgctccagatagatcgcattctttgcgcgtccttccttcgttgcaacagaagcgtgagttccgtcattaaagattacacagttttgcagaacttccacaacagatgcacccttatggttggctgctgctttcagaacctctacagaagcggcgccgtctacagcgatacaacgtgcaaagaaacgtccgcgtgcaccgaatgccagttctgccggatggaaagggtcttctaccgttccgtaaggagatgatttgctgacgaatccgcgttcggaagtcggtgaatactgtcctttggtcagtccatagatacggttgttcaacagaatcatgttcaggtcgatgttacgacgaacagcgtggatgaagtggttaccaccgatagccagaccgtcaccgtcaccggaaatctgccagatagtcaaatccggattagccactttagcacccgttgcaacggcagcggcacgtccgtggatggtatggaagccatacgtatttacataataaggcagacgggaagagcaaccgataccggaaattacggcgatattgtgcggagctactcccagttcggccattgccttgtgcagtgagttcaggaaagcgtggtcaccgcatcccggacaccagcgaggctgacctgatttataatcttgtacggtatatactttatcgctcatctcttattcctccaataatttagtaaatgcatctatcaattctctcgtaacgaaaggctgtcctttcacttggttgaactggctgatattcagtccgggtactttcatacgcaggtaaccggcaaattgtcccagattctgttcggctactacgatcttcttatatttacgtaatacgtcggctgtattcttcggtagcgggttgatgtactggaagtgtgcgaatgcaaccttctttccatgttcgcgcatgaagtccatagccagacggagatgtccgtaggtaccgccccagcctacaatcagtaagtctgcgtcttcgtcgcccagcacttcaagttcggggatgtagtctgcaatcttgtccacttttgcctgacgcaggtgaaccatcttgttgtggttttcgggttcggtagagatggctccggtttcgttactcttttcaagcccaccgatgcggtgcataaaaccttctgttccaggagtcgcccagtagcgtgcgcttgtttcttcgttacgttggtacggggtccagttgcccgccatgtccggagttacatacggagggttgatggcagggtagtcattcagatcgggaagtttccatgcggcagagccgttggcaacgaaagcatctgtcagcaatacgaccggagtcatgtgttccaaagcaattttggctgccatgtaggcggcatcgaaacagttggtcggtgaagtggcggcgataaccggcattgggctttcaccgttacgaccgtagagtgcttgcagcaagtcggtctgttccgatttggtaggcagacccgtagacggaccaccacgctgtacgttgacaatcaccaacggaagttcgccgataacggccaagttcatcgcctcacttttcaggcagatgcccggaccggaagttgtcgttactgccagcgcacctgcaaaagctgcaccaacggcagaagcacaaccggcgatttcgtcttcgcactgtacggtttttactcccagtgatttatgcttggccaattcatgcagaatgtcggtagccggagtgatcgggtacgaacccagatacagttccaaaccggctttttcggctgcggcaatcaatccgtaagatgttgccttgttaccattaatatctgtataaagcccttttgatttcggagctttgctttcaatcttataagtagaggtagaagcgtgtgtgttggcaccgtagttgtagccatcgttcaataccttaatatttgcttctgcgatttccggtttcttggcgaacttctcgcgcagcatcttttccgctgctgccagattgcggttgaacagccagcaaaccagtccgagcgcaaacatattcttgcaacggagaatcgttttattgtccagtccggaatctttcagactttctttgcacatagaagagatgggcacttccagcacttcttgtttaacgcctaattcttcaaaaggattgttggtcttaaattgtgctttttccaggtctctggcttcgaacgagtcggagtcggtaatgataagtccttgcggtttacagaatttgatttgtgttttcagtgcggaggggttcatcgctactaatacgtggcaacggtctcctggagtgtacacctgtcctgcgcctacgtggatctgaaaaccggaaacaccggtcagtgaaccttgcggggcacggatgtctgccggatagtcggggaatgtacagatgtcatttcctaccgtagccgacacgttcgagaagatgttgcctgccagctgcataccatcgccggagtcgccggagaaacgtactacgacttcctccaattctttaaccatcatttcgtctgccataactttaattactatatttaatttaaaaactgattttactttcaatttgtgagcgcaaaggtcggaaagttaatcgaattatcaaaataaatcgaactttattgtcctattgacgccaaataattggatttactgaaaggaacctgcatttttattcttgttaaatcaacagaaaccgttatctttgcaaccaaaataaaagcggccttgtagttcaacggatagaatagaagtttcctaaactttagataggggttcgattcccctcggggctactaagagaaatctgcgggaggcggtgttgttttgcttcatactgtattgagttttaagtattacaatggcttcttttaagattaacgtcttatagcttctatttgttttaataatcaatagaaaaagcctcttccgaatgttcggaagaggctttttctatttctggaatttattattcttccgtagctgctaccactacttttttgttcttcatcatgttgtatgcaatcggagatgcaatgaacaacgaagataaagtaccgataacaacaccgaggatcattgcgaatgcgaagctgcggattgaatcaccaccgaggatgaagatacacagcaatacgatcaacgtactcaatgaagtattgatggtacgagccagtgtagtgttcagagagtcgttgaacaactgacgcttgtcacgtttcggatacaagccgaagaactcacgtacacggtcgaagattaccaccttatcattaatagagtaaccgatagccgtcaggatagcaccgatgaatgtctggtcgatttccagtgagaacggaacgataccccacaacaatgagtaagcaccgataatcatgatcgtatcacaagtcagagctacgatagaaccgatactgtaagcgatgttgcggaaacggatcaagatatacagaccgatagcgatcagagccagaacaactgaccatacggcacctgtcttgatatcgtctgcgatactcggacccactttctgtgaactaacgatactaccgcctgtgtgattgtcacggtcgatgaaagtagccagtgtgatgttctgtgtcagcaacggcttcagtgtttcgtataagtatgattcgatctcagagtctacattgttaccttcgtctgcgatacggtagttggtactgatacgtactgtcttcttgtctgtaccgatagcgatcacatttacatttacatcttcaccaaacttgtcagcgatcagttcacgaacttgttccggttctaccggattctcgaattgtaccttgaagttacgtccaccggtgaagtcaatactttgacttaaaccacgcaatgcaaacgaaccgatacaaacaaggataatagcgcttacgatgatcagtgatttcttattggttcccatgaagtcgaaacgggtatttaccagcaagtttctggaaatcttggaagtaaatgtcaggttcagccacttgtctttattcatgaagtgttcgtaaaccagacgagtcatgaacacagcagtgaagaaggatacaaggataccgataatcaatgtagtggcaaaaccacggataggacctgtaccgaagttgaacaggatgataccggtgatgatagatgtcaggttggagtcgaaaatagcagagaaggcatttgaataaccgtcagccaatgctttcttcacacccttgccggcacgaagctcttcttttgtacgttcatagataagtacgttcgcatccaccgccataccgagtgacaacaccataccggcaataccggacatggtcagtgccgcctggaaggatgaaaggatacccagcgtgaagaagaagttcaggaacaatgcgcagttggcaaccatacccgggatgaagccatacatggaacacatgtagatcatcaacaggatcaaagctacaacgaatgagaaaatacctgcgttaatagattcctgacccagagacggacctacgatatcttcctgtacgatgtgggccggagccggcatcttacctgatttcaatacgttagctaagtcctttgcctgttccggggtgaagtgacctgtaatctgtgaacgtccgcctgtgatttcagagtttacgttcggagcagaatatacatagttatcaagaacgatagcgatagaacgaccgatgttctgcttggtcaactgtgcccagcggcgtgcaccgtcagagttcatggtcatgcttacagccggtttgctgtattggtcgaattcgtcttttgcatctgttactacgtcaccttccaacggagctttgccgttacgttcggtagatttgatagcatacaattcgaatgtctgtcctttcttatcgaattcagaaggagaaacaccccatttcagacgaaggtctttcggaagttctgactggatttcaggcatgctcagatatctgttgatatcggctgtatccttatagttagcatagccgatcaccggaccctgaccgcttgaattcaactgaagaacagctagcaacggatattgctttttgatttcttccatgtttgctcccgccttttcgtctttggcatctcctttcagagtagctgcgagactgtcggcaacgcttacggctttctttgccggagtagcttctgccagcttggctgcggggattgtgtctgcagttgcgttagtggctgtagaatcagcggcagtttcctgtgacaggatagcacgcaattttgagtcagccgactgcatagccggaagaatctcttttgcagtatatgtttcccagaattcgaggttggccgaaccttgaagaagttttctcacacgttccggctccttgatacccggaagttccaccatgatacggcccatcttatcttcgaggctttggatgttcggctgaacaacaccgaagcggtcgatacgggtacgaagcacgttgtatgagttttcaacggcagcctttacttctgctctcaatactttttctacttcggcatctgatgatttctggttaactttatctttcaactgttgtgttgcgaaaagttcggaaagttttgcgcccggagcagtcttctggtattctctgacgaacaaggtaatgatatcgtcctggctgttgacagcttgttttgcagcttcattcagcgctttattgaagttttcatccggcttgttgtcagccaatgctctgataacatcaggcacagaaacttcaaggataacattcataccaccttttaggtccaaacctaaactgatctccatttcacgacaatctttcagcgtccagttccacagcattactttctcattggagagagagtcaaggtagtcttgttctactttcgggtcgccgttcgcaatctctttcgccttattagtgtaatggcgggttacgaaggagaaggagaggtagaacacgcataccagcgtgagtagtaccgcaaaaacctttacaaatcctttgttttgcattttacttttaatttatgatgattacttttttaatttaattttcagttaaattctgtcgtatacaagtccattttgccgcatacaaggctgcaaatatagtttttttttcacattcatatgtaataagccctcaaatatttgatgtttaagggcttttttgccgttttatttcattcctctgtttttcagtaacggctccaggcttggttctgcaccgcggaaattcttataaagtatcatcggatcttcgctgtctcccttttccaatacgttgtagcggaagaggtcggcagtgtttttatcaaagattccatgttctttgaaggcttcaaaggcatcattgtcaagtacattcgcccaaaggtaactgtagtatccggcagcgtatccgccaatgatatgattgaagtaagtgacgcggtagcggggggcaatttcggggatcaggccgagcttgtccatggcttctttttcgaaagcaagcatatccagattctttacatctgttatcatgtgaaggttcatgtcgaggatggcggcagccagtaactcggtggtcatgaatccttggttgaacgttttctgtttcagaatcttttcgatgatttcatcggggattacttctcctgtctgatagtgtttggcatacattttcagcacttccggttcggtagcccaatgttcgttgatctgagaaggaagttcaacaaaatcgcgtacgacattggtgccggaagtccctttgtattcgcactttgtcagtaagccatgcagagcgtgcccgaattcgtggaacagagtttctacttcgtccatagtcagcagagaaggggtgtcgccgaccggtttggtgaaactgcatacgttgcataccaaggggcgggttgctccctgctgttcgcggtaattgctcatccatgcgccaccgctttttcctgaacgcgggaaatagtctacatagaatatgcccagttgggagccgtcagcgtctttcacttcgaagacttctacatccggatgataagtcgggataccttccagtttgttcagagtgataccatatagtttgttggcgactgcgaaagctccttcacgtacattctccagtttgaagtaaggtttggtgtcttcttcggagaggttgtatttctctttgcggagtttttctgtgtagtaccaccagtcccaggcttccagtttctctcctttgccttctttgtccattaactgttgaagttctgcggcttcggctttcgctttcgggagggcatagctccaaaggttgttcagcagactcattacgttgctgtcattctttgacattgtctcatccagtacgaagttggcgtagttgttgaagcccaatagccttgctttttccaggcggagggagacgatcttgcggatcgtttctttgttgtcattcttgtcattgttattgccgcggttgatgtatgctttgtacattttctcacggagagggcggttctcagcgtattgcaggaacggaaggcggctggcgttgtgcagggtgaacagccatttccccggttgtccggcagctttggcttcttcggctgcgctttggcagaaccattcgggcaatccggctaaatcttctttcttgtctacgaaaagctggaaagcattgttttcattcagtatattattgctgaatgtgatgccgagagtggaaagttctttgttgatttcacgcagacgtgcctgtttctctgcatccagattagcacctgaacggacaaatcctttgtaagttttgtccagcagacgtttctgttccgtggtcagattcatggaatctttctgttgatatacaacgtttacacgtttgaaaagctcctgattcagggagatgttatcttcgtgctcggaaaggaccggtgccattttgatagagagctcggtcagttcatcggttgtttccgcatccgtcatattgaagaaaatggcgcttacacggtccagaatgggtgcgctgctgtccaaagctacaatcgtattgtcgaaagtaggcacttccgggcttgcgataatggcttggatattctgattctgctcttcaatacctttcagaaaggcgggttcgtaatgttccagtttgattttatcgaaggaaggaacaccatactctgtttgaaattcagtgaagaaagggttgctttctgtttttgttccacaggagtacatcatacaacttactgctaaaatggttaaagtttttctaatcatcatggtatttatttaagtttttctgctttattgcttgcctatatagcaccagatcgggtaatggtccgaatctttgatcgaacggtctacggtgcagttgtaggctttctggttggggctgatcagaatattgtctatccggaaatagaatttattcagattataggagatgcccagtcccctgccggattgtgtaaaggcgtcatccagctgttgagtcaggatgcgatgggtatatgaaatggaagcgtcgttgaaatcgccacaggcaataatagtcgggtatttgctgtttgcgatggcgacggctaccgaatccgcttgcgaagaacggatggccgatgcttccgccagtttctttattaattgccggagacccgtttttaccttctttgcgttcgggtctttaatcatatcttcataaatcaccttgtcttctttcgtcagtttattggattccagatggttgtttatgagggtgatagtgtcctcgttaactttgagggtgtactgcatcgaactgttgtaggtgctttcatacttgatgggacgtgccgaaagtatggggaatttggagaaacaggccaactgactgcctcctttttccggattgtgaatggaacggtagggatatgctttcaatgcttttctgatgtcttcgtctgtcagatatttcttgtttttggttgaattgtactcctgaagacagattatgtcagcttcactgtcagccagataggataatatcggattctttccttcctttttctccagattgttaaatcccatcacattgtaagagaggaatttgatgctgccatccggtatcgtttctactgtagaattgatgggaatataggtgcgtatctgtggaatacataccagaaaaccgatgaccggtaataaggcatagcggtagctgatgattacccagaatagggtgaaacagatgttgacagcaaggaagatggggaaggcaagccccaggcaagaagctatcgggtgtattttcggttgaagatacgggctataggcactcaaaatcaacatccctacaaagagtgcgttgactgccaatatcaaataaaggacaaatttgccaatgtgttccattctttatcttttgcttgcgtcgaacaagctctttttctcttccgtcgtcaggctttcataaccggattttttcagcttttccaaaatgcggtctacttcatccgattgtgctttcttacgggcgttataatcgtaatctttctcgcgacttgtgtcgcttccataatgtactttcatttttggtttgcgtttccatgtctttttctgaaacagggaagcgaagccgtcaaggaaccagttgatccagtaagtcacgtctttgcctttgctcagactggctgcaaaccaaagtccggcaagtgcgccgcctaagtgggcgatgtgtcctccggcattgttggatgtaataaagagcaggtctgttccgataacgatcagtgcgaggtatttcaaacggacggcgccgaaaaggaaaagttgtacccggtagttcggttctctgtaggcggtggcagctacgatggccagcacggaagcggaagccccgaccagtgtggagaacggcaatgtctggctgaaataagggaagatgttatacgctatcatgtagaacaatcctccgcagatgcctcccaatacatacaatccccgtaaatgctttcccgaaaagaaatagagaaacagacttccgaaccagtacagccagagcatattgaacaggatatgcaggaagcctgcatgcatgaacatgtagctgagcaatgaccatggctgaagaataaaccggtgaagggaagccggaagggcgaataaatcgaatattcccgttgcactcaggttgaacagctgcaatatgacactgattaacgtaccgataacaaagatgcctacgttaatgtaaatcagtcggatgaaagtgtttcctcttctgaacgtttcttttaaatcagttataatatgtcccattgtttctacttttttttctccaatacataatcaggataaatccgaatatcatacctcccaagtgggcgaaatgcgcgacattatctccgggattattggcaaagccggcatacagttcaatcaaagcataaccgataacaaagaatttagctttgatagggaagggcagcggaaagatgaatagctggttgttggggaacaacataccgaatgcgagcaaaatggcatatacagctcccgaagcgcccacggtggtcagcatgttcaaaaactctcccataggaataattcccgttcctatatccacttgtgaatagtggctgtagtctactatatatttgatgtattgcactccttcctggataagtcctgcaccgataccacaggcgatataataaaaaaggaaacgtttcggtccccaggtccgttcaagaacagttccaaacatgaaaacagcaaacatattgaaaaaaatgtggctgaacccgccatgcatgaacatataagtgataagctgtgccggattgaagtcactggcgaggaaaaaatgcaatcccagataattagtcagatcgataccgtatcgttgggcgacaagtgtcccgaaaaagactagtacattgataattatcaggtttttagttacagttggcataattttatattctgaatatttaagtaatgaacgcaaaagtacgaataaattctgttttaaagcatggaaaagcttccctattagctctttttcaataatttgctgcgttttttttatgtttttatttgatatgttgttttgttcatctatatttgtaaagtcgtaatgggaaatcttttgtgtaacatatatattaattaatcattttacgtatcatgaataagtctgaacttattagtgcaatggctgctgaagctcaaatgagtaaagccgatgcgaagaaagctcttgatgctttcatttcttcagttactaacgctatgaaagctggtgataaggtagctttggttggttttggaacgttctctgtaagtgaaagagcagcaagaaccggtattaatccttctacaaaggcagctattactattcctgctaagaaagtagctaaatttaaagctggtgctgaattgtctgcagctgttgaataaacatatagttgaaagaaattagaagagggaggcgcgtgcgtctcctttttttgtatctttgcgcgcaagaaacaacttgattatgaagatagaagataaacttgtagcgtccgtcatcaacggactaaaagcactttacggtcaggaagtccctgagaagatggtgcagttgcaaaaaacgaagaaagaatttgaaggacatttgacactggtcgtgttcccttttctgaaaatgtcaagaaaaggaccggaacagacagcgcaggaaattggcgaatatctgaaggcgaacgaaccggctgtagctgctttcaatgtaataaaaggctttttgaatctgactattgcatcggctacctggattgagttgctgaatgagattcagtcggatgaagagtacggcctggtgaaagctaccgaaacttctccgttggtgatgattgagtattcttcaccgaataccaacaagccgcttcacttaggtcatgtgcgcaacaatcttttgggaaatgcgctggctaacattgtggctgcaaacggaaacagagtagtaaagacgaatatagtaaacgaccgtggtatccatatctgcaaatccatgctggcatggaagaaatacggaaacggcgaaactcctgaaagcaccggcaagaaaggtgatcatctggtaggcgactactatgtgtctttcgacaagcattataaagcggaacttgccgaactgatggaaaaaggcatgacgaaagaggaagcggaagctgcttctccgttgatgcaggaagcccgcgaaatgttggtgaaatgggaagccggtgatccggaagtacgtgccctgtgggagatgatgaacaactgggtgtatgccggatttgatgagacttaccggaagatgggggtcggcttcgataagatatattatgaatccaatacttatcttgaaggaaaagagaaagtaatggagggactggaaaaaggctttttcttcaaaaaagaagacggctctgtctgggttgacctgactgccgaggggctggatcataagctgcttcttcgtggcgatggaacctctgtttatatgacgcaggatattggcacggccaaacttcgtttcgctgattatccgattgataaaatgatttatgtcgttggtaacgaacagaattatcacttccaggtactttctattctgttggataaactcggttttgaatggggtaaaggccttgtacatttctcttatggtatggtagaattgccggaaggtaagatgaaatctcgtgaaggaacagtcgttgatgccgatgacctgatggaagagatggtatcgactgcaaaagaaacttcgcaggaactcggaaaactggatggtctgacgcaggaagaagcagatgatattgcccgtattgtcggtctgggtgctttgaagtactttattctcaaagtagatgcccgtaagaatatgactttcaatccgaaagagtctatcgacttcaatggtaatacaggaccgttcattcaatatacgtatgcccgtattcagtctgtgcttcgtaaagcggctgagtctggaattgtgatacctgaacagattcctgctggtatcgaactgagcgagaaggaagaaggattgattcagttggttgctgactttgcggcagttgtaaaacaggccggagaagactacagtccgtctattatcgcgaattatacctatgatctggtgaaagaatataatcagttctaccatgatttcagcattctgcgtgaagagaatgaggcggtaaaagtattccgtattgctctgtctgccaatgtagcaaaagtggttcgtttaggaatgggcttgttgggcattgaggtaccttccagaatgtaatacctgccctgaacaaaatatatttatgtgttccggaacgggactgggatgttgttgaatagaaaaagactgtccgaaaaggaattgtactctatctttaagaaagactttgggtaaagttaatgatagggattacatacttttcagacagtcttttttattattgggtaattactttcgaattatcagggtctttccaccaatatggattggaagcgccgaagctggatgcccagtcaccaaatttaggatacgcttccaaaatgcttgtcgtttctactggtacaaggaaatcggtaccacgtttagttcctacactgataccgctaatctgcagtcccgttggcatattctcattatttacataatataatccctcatcaggcctggatacatcactacctgtgccgaaataagagaaattcattttacttgttggagggaatttcacaatatgtgcttctttatcacgtcctgtattggcagaaatgatgataaaggggttcatattaaatttgctgtatgtttgttcccaaaatttgttattaaagaaaggagtaaatgctgtttctgtaaatctttcttgggcgacgtctatcgttacagtaaacgttttgtttatagctgctttttgattgtcaaaaaggataatagtgggataattttgaccaggttcccggtcttgcccttccatgaattgtgagacgattccgccggattctacggttattttctttatatcactatttgctatacctgtgagctggtaaccaaaaccgttttgccagtttgcgccatcatgtttaggcacaaatgtatctataacttttacgactttacttgtgagaacactcttataaatttcgcgcttatattcgacaatcatatcattcatgtcataatctcctttggatggccaaaaatcttcaaatgataatacacctttaaaggagttataaatctctttgttgtcaatggatttgtctgggagttcttctacaccaccagtctcaatggctgatccatctgagaaatcaagatagaatacggcatcgccaaagtttccttttctggtattatctcctgtcggttcaaagttggttgcatcctccataccaaatgcaacgacttctcctgatttgttctttagggcaatggtacggtgttctttgctcttattcagatcacgaatagaatagaaagtacgtttattattcataatctcctttgtgccttggttgtaggaagactcaataagaaaccatgctatgcttactcccgcagggaactcgttcacgaactttgtgccatcccaatatttcagttctactctgtcgccggtatacatactacctgctgtactgctggaattacacacggcagtcgatatgcgcggataggcaatgatcggtgtaacttgacttatatcagtcggcttctgatcggtagggtaggtgaaataaccgactgtgttttgtttggtacctgtactgctgagcataaccagtcctatttctgttggtttcttaacattgatttctatatttacattatcacctatatattcaggataataatcttccatcgctgcacttccacccggcttaataaaaacttcacggatattatacatgagctgcccatctatttccgttggagtagaagaaagataagtaggacatcctatctcattccattcacctaaaacctggaaaccttccggatatttgtagccgctattggtaacccctctactcgtacccttcgcatttctcttactttgtataaaagcttgctgatcaaaagatacttttccgtttgtaatttgtagctgaatcgggctgacagttccaagatagtctgaataaaggtaaagttctgtaagataagacggaatagatatgaaatcattaaagattccttttttatccgtagccccgcgatagacaggctcttcttttgtcttgataatgtttccatccttatcttccgatagcggattttcggcatataactcaaaaacaacctgataatttaaaccatagtttaaatcaactgtgcaactggaggatgttgtaaagccaaagtattcatctgcagttttttcttctggagcctgatataagtccttttccatacaactggctaacgagagtgcgcatagtacccccattgagagagatttgaaattgtttgtttgcataactgtgttctgataatttgattgtgacccgcaaatgtatgcatttaatatatcaaaacaaagagttaggaaataaatcgtttaaaaagaaatatatagcatggtaaatacaacaaaagtccggtaaccagttgatataggttaccggactttgatgtctcattggatgcaaatattatttcttttttgcggttcgtttacctttggcagaagtgccaggacctttctcatcttgtattttgattagatcgaagcaactcttcaaactcagatcttgaggaacaatgtctttagggatcttgtaattattacctttgtatgcaatgtaaggtccgtaccgaccattcagaatctccagttccggttcttcatcaaattttttgatatggcgttctgcttctttcgtccgtttttccagaatcagctgctctgcttcttccagagtaactttcatcggatcaagtgttttcggcagtgatacatataccttgttatgctggatgtaaggaccaaagcgacctatacctacagtgacagtctttccttcatactcacctaaagtacgcggtagcttgaacagttccagcgcttcctctagggtaatggtctccatggactgccctttcttcatctgggcaaagcgaggcttctcttcatcatctgcggcaccgatctgtactacagggccgaaacgaccgattttcacagatacaggcttgcctgtttccggttcttctcccagcatacgttcgccgactttatgttctgtctttatggataatgtcttctctactgccggatggaactgatcatagaaagtcttcatgatcgaagtccattttacttctccttccgctatttcgtcaaattccttttctacactggcggtaaagttgtaatccagaatatccgggaagtattcggtaaggaagtcattcaccacagttcctgtatctgtaggaaagagtttcgacttttctgctcccgtcacttcattgtgactttcatctttaatctgattgtctttcagtgtcagcacattaaatgtacgctcttcaccgtctttatttcctttttccacatattcgcgttgctgaatagtagaaatcgtaggagcgtatgtggacggacgaccgatacccagctcttccagtttacgtacaaggcttgcttccgtatagcgtggcgggcgttgagtgaaacgttcagtggcaacgataggtccatattccagtttctggcctttttttaaaggaggcaacagacggctctcatcttcctgttcattctcatcgtcgtaagactcacggtatacacgtaggaaaccatcgaacttgataacttcgccgatggcagtgaatgcatcaccgcttttgcttatagagatagtagcagtagtcttttccagttccgcatccgccatttgtgatgcgatggtgcgcttccagatcagatcatacagtttcttttcctgtgctgtgccttctatggattgattttccatgtaagtcggacgaatggcttcgtgcgcttcctgtgctcccttcgtctttgtttcgaagtggcgcggatgtacatagcgttcgcccatcatctgtatgatagcgtctttgctgctggctgttgcatattccgacaggttgacggagtccgtacgcatataagtgataaatccggattcgtacaaacgttgtgcgatcatcatcgtttgtgctacggtatatcccagtttgcgtgccgcttcctgttgcagggtggaagttgtgaatggagccggcggtgttttctttaccggacgggtggttatatcttcaatcgtaaaagtcgctcccttacatgcgtcaaggaatgcttttgcttcttctttcgtcttgatacggcgtgacagttccgctttcatttctaccagcttgccgtctgtatcgggaaccaggaatatggcaataacccggtaagcggcttctgatttgaacgcatgaatttcgcgttcacgttctacaatcaggcggacagctaccgactgtacgcgtcctgccgacagagatggtttaacttttctccaaagtacaggagacaattcaaaacctacaattctatccaggattcgtcgtgcctgctgtgcatttacgaggttgaggtcgatattgcgtggttgctcgattgcttttaaaatagcacctttggtaatttcgtgaaatacgattcgctttgtgttttccggttttagttttaatacttcatacagatgccaggcaatagcttctccctcgcggtcctcatcggatgcgagccatacggtttctgcctctttagcttctgctttcagcgtgctgaccaaagcctttttgtctgccggaatttcataatcgggtttaaaattcttatctacgtcgatactgaattctttcttcttcagatcacgtatatgtccgtaactagaaaggactttgaaatctttcccgagaaatttttcaatcgtttttgcttttgccggagactcgacaatgacaaggtttttttgcataattctttcttttataatggcttgtaccataatatttcggggcaaaagtaaaaaaaaagattcgccctaccttataatataaggagaaactaatatttttttggaaaaaaataggttttgagtaaatctgcatttcttttgtatgtgcaagtactctattacaaaatagagagtaaagagtataggggaattatgtatagttaatgtgttgtatgttagatgattatgcgactaatttgcgcatagaatagtatggctgtaaaatcaggccggatgattcttgtttaatgaaaagtagaaaacgacagcactcgtttgttggaaaaagagaattatgggatgaattatttttttatagcaatagcatttttagttgcggtatttatggggtggattatcactcctcagattttgctcgtagcttttagaaaacgactgtttgattctgtaggtggtcgcaagacccatagcggtatagtaccacgtttgggaggagttgtgttcgtcccggtgcagtgctttctattagtgctatctatgttttttatgtataaactagaaataacgtcctatcttcaagacccatttatacctttccaatttttattgttgatgataggtttgctcattttgaatatggtcggagtgatagatgatttgattaggattaactatcgtagaaaattcgtagctcaaattgttgcttcttcatttcttccgttatccggactctggattaatgatttgtatggactactcggaataactactttatctccttggattggaatgcctctgacggtgtttgtggcagtctttattattaatgccgttaacctgattgatggaatcgacgggctctgttccggtttggtcggtatgggggctttggtttttggtttcttgtttatttataatgcagcatggttacatgctgtttttgcctttatcaccgcaggggtgctatgtccttttttctattacaatgtgttcggcaaatcgaaaggaagacaacgaatttttatgggggatactggcagtctgacgctggggctctcgatggcttttctggcaatcagctatgcgatgaataatccgttgataaagcctttttccgaaggagcgatagtagtttctttcgctacattgattgtccctctttttgatgtagttcgtgtggtacggatacgttattttcagcataagcctctttttatgcccgaccagaatcatatacatcataagtttctgagagtagggatgtctcattatgtcgcaatgattcttattctggctttggcattgttctttagcttcttcaatattgttgcggtagaatatatcagcaacaacatcgtgatttttatagatatcgtactgtggattgctttccatttatggttggacaggcgagagcttatccgggcaaaacatggggtggcaaataattaaatttaatgatatgaaaatagctattatcggtggttccggattcgtgggaagtcgtttgatcgggctgttacagactgttccgaacattgaactgctcaatattgacaagcagcagagtgaactttatcctcatctgacacaaatagctgatgtgcaggatgtacagaagctgacggagttgctggcaggaactgatcttgtggttttattggctgccgaacataaagacaacgtaactcctgcatcgctttactatacggtgaatgtggaagggacacgtaatacgcttcaggctatggaaagtaatggagttgcccgtttggtattcaccagttctgttgctgtctatggattgaacaaagataatccatcagaattgcatccggccgatccgttcaatgattacggtcgtagtaagtggcaggcggaatgtatgctgcaggagtggtatgatacgcatcgggagtggaacattcatattcttcgtcccacagttatctttggagagggcaacagggggaatgtatataatttgttgcggcagattacttccgggcgatttctgatggtaggagacggtgaaaaccggaagtcgatggcctatgtcggtaacgtagttgcttttatcgcttttctgattgagaataatatggagggatatcatgtattcaattatatcgataagccggatttcacaatgaatgatttggtgtatcatgtcggggaggtgttgaataaacatattcctactacacattacccctattggttaggaatgttgggtggatattgctttgatgctttggctaagatgacgggaagaaaattgtcggtgagttctgttcgtgtgaagaagttctgtgcggtgactcagtttgattctgttaaagtacagtcatcgggttttaagccggctttctcaatggaagaagggttgagacggacgttgcaatacgagtttggttcaggagctgaagaagctattaattgataaactaggctttttcctttttacaggatagaaaagaaggaaaaaagttagatagataagacataaaatttttcaggtagccgtcatgtatgtgactggcgggagcggagcgcgcttggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatcttttcttccgttacaggaagaaacacgtcgttggagtgaccgaagcaagaaagtgcagcgggtcgtgattcctatggttgtttttgcccggatagctccttccgaacgtatttctgtgcttcgtcttccctctgtaagccgctttatggtattgcgcggagaaagtgctccggcaatcatcccggatgcacaaatggaacgtttccgctttatgctcgattattcggaagaagcggttgagatgtgttcggagcgtatccagccgggcgaacaggtaaaagttatcaaggggccgttgacaggattaacaggggagctgataacaatggatggaaaaagtaaggtagccgtcaggattaatatgctgggagctgcgatggtagaagtgccggtagggtttgtagagagaatatgatactgttaggtaattactactaagaaaaaacaactgagattacaaaccatgaaggaacagcagattacagtaacttcccctttattaccatctttggaggagttaaatgtttacttgcaggatatatggcaacgcaaatggattactaataatggatattatcatcagatgctggaagccgctttgtgtgaatatctgggtgtaccttatatcagtctgtttaccaacgggactcttcctctaactgcggccttactggcaatgcgtattacaggagaggtaataaccacgcctttcagttttgttgctactacacattcgttgtggttgaatggcatcaaaccggtatttgtagacatagaccctgtaacttgtaatcttgaccctgataagatagaggtggctataactcctaatactacagccattatgccagtgcatgtgtatgggtatccttgtgatactaagagcattcagcaaatagcagataaatacggattgaaggtaatctatgatgctgctcatgcatttggggtggagagagagggagaatctattttgaatgcaggtgatatgtcgacattgagctttcatgcgacgaagacttttaataccattgagggaggtgcattggtacttcacgatgaacatactaaaaagagagttgattacttgaaaaattttggttttgtcggtgaaacggaggtggttattcccggaactaatggcaagctagatgaagtgcgggcagcttacggattactgaacttaaaacaggtagatgctgccattgaagcacgctgccaggctacaactaattatagagaagccttacgtaatgtttccggtatcacatttatggatgatatatccggagtgaagcataattattcttatttccccatatttgtggatgaagaacgatatggtatgagccgtgatgaactctattttaagatgaaggaatataatgtattaggacggcggtatttttatccgctgatcagtactttttctacttatcgtgaattaaagtcagcaaggaaagaaaatttgcctgtagccacaaagatggcggaacaggttatttgtttgccgatgcaccatgcattgagcgaagatgatatggagcgggtgttacggctgataagaaagtagaatatgaaacttggtgtgatgcaaccttactttatgccttatatcggttatttccaattaatgaaagctgtagataagtatgtggtttatgatgatgttaattacattaaaggcggctgggttaaccgtaatcatatactgatcaatggagagaaagaaatgttcactgtgactttgaagaaagcgagtcagaataagttattcaatgaaatagtgataggcgatgattttaagaaacttatgaaaacactgcaactgaactattccaaagctgttaactttgatcagacgatgactctgatgaaaagaatcatttctttctcagataagaggcttgcggcatttatagcaaatagttttcgggaaatattcagttatttgtcaatagatacggagatattgatgtcctcagatattccgaaagataattctctgagaggaaaagataaaatcttgcagatatgtgaaatattgggtgctgatacttattataatgctatcggtgggcagaatctttatgataaaaaggaatttagtgaacatggaattgtactgaattttgtagatacaatcccaaaagtatattctcaattgcgtactaaggaatttgtgccttatttgtcgatgatagatgtattaatgaataataccaaagatgaagtcaatgatttattggattctttttgtgtaagatattgaaattgcttagatatgaaatcttttaatattgtagtgtgtgcgtctggtggtggaggaaattttcgttctttgataaaatatcaatgtgattatggttatcacatttcgttactgatagtagatagagagtgtcctgctattaagatagcaaaggaaaatgggatatcatattccgttttagaaaagaaagttttaggcaagtctttttttgaggagtttgagaagattgtccccatagatacgaatttaattgttttagcaggatttctaccgattatacccaaatggatttgtgaaaagtgggaacgtaaaataataaatattcatccttcactattgccaaaatatggagggaaaggcatgtatggggttaaagtgcaagaagctattttgaggaatcatgagaagtatgccggctgtaccgttcattatgtggattcggaaatagacactggcgagataatagctcaaaaaaaaatacttgtgatggagaatgagtctgcatgggaattgggaggcagagtttttaatgaagaaataatattacttccgttggctattaaacatatacgtgaagcaatgaaagtgattccttaagattgaatataagtgtattatataatattatacgattttcgatatgacacacttttatttgtgtgctgaactatgctgatttaaagtcagaaaaataataggttctatgtcttagttcttgtagaactataatatagtagatgataagatggaatagaatgcatgttgttgataatcaatgggaagtattgggggctgtaaacgtgtaatagtgaaatactcactctgtttctacccgttgattgattaaatgagaataattgaaaaacttatttgtaatttaaatatgaaatattattgaaaaatagtatgactttttcaaactaattagtatatttgcgcacgaatcgttgatttttagcaaaaaagatggtaaatctattgcttagttagatgcgttagtttagatacaaatggattaacagactgttttttgtgctaagttctacaagaacttagtttaattattcctctattcctttttaattggttgattgtttcggtcagaccgggcgaaaaactcacttcttaaatataaagcattttggcagtcgtttaattacgggtgtaagggagaaactatttaattgctatttggatagtacacagcgtgataaaggttgttatattctcaaagagttctcatgcctttgagaaaaaattctcaccacactgagaaaaaattctcaatgcaatgagaaaattttctcaaaggcatgagtattttttctcagtgcagtgagaatataatgaaagcttcaataaaaaagccaactaaatccataatgggttagttggcttttatattagaggatttatcctttgtttcgggaatatttattcttccgctttcaatgattcatcgataaccttgattttctgtaataccagttcaaggtcagctttcagtttatccacttttcgattcagttcagtcagcaggctgctacctttcttggaagaagaagtaaggaatcccaggttattttcataagtctgaagttcattcttcatattctcataaatacgtaccagtttttcccgttctctatataaagactgagagcctcctccttggatattgctgatgtttgaacggaaattgcttaatttcttgttggatgcactgatgttgaaacggtcgaacagttgatcgatcaagccatgatattgcttatacaatttgtctttctccttgaacggaacatgaccgatggtattccactccttcatcagttcgcgtaccaaagtgctggcttcgtcagtatccatgttttcatcgattgaagctaatttttcaatcaacgctttcttcttctccatgttctctatttctacagaacgttgtgaagaagtagccttgtttttctggtcgaagaaatagtcacaagcagtgatgaaacgtttccatacggcatccgagtatttcttggctaccggaccgattgttttccactctttctgcaatttggtcagcgcatcagcagttgctttccagtcggtgctgtccttcagtgcttctgccttttcgcaaagtgctttcttcttttccagattctcgttcattccttctttcagagccttgaagaattctcctttctttttgaagaagtcatcgcaggcatgacggaagcgttcgaagatcttcacattcatcttttggggagcgaatccgattgtcttccatttgttttgcagagcaatcacttcctgcgtcttgttctcccaagccgagaatgttttcagttcatcatattcaattgcttctacaatttcgcaaatgacagttttttgatccagattgtgctgttccgattctttcagcgcttcgaaatgttgctggtgacggcggtttacagccgtagaagcagccttgaaacggttccagatttcgtcacgcagttctttagctaccggacccgtatcacgaaattcctgatgcagcttctgaagttggtggaaagcggaaactacatcttcttcgtcagcaagcttttcggctgcttcgcaaagatgagtcttgatctccagattctttttgaagtcgtattcacgaaattcgttgttcagtttcagcagatcatagaatttctctacgtacagttggtaattcttccaaagttcattcaccttgccctgcggaaccagtttggtttcgttccattgttgttgcagctttttgaactctgtataagatttattggcatcatcacccgattctaccagttctttaagttcttcgataatggaaagcttgacttgcagattttcttctttctgacgttcctgttcggctacaagttgacttcttttctctttgatcgatcccatgaggcgtttgaattcctcttctgtcggatcatccttcggagtgaagtcttcggcagcgcctccattgtcgataaattgctttttagcagcttctaactcggcgttgtgtaacttgtagaatgattgttttagattgtcaatttcctgcttgtttgcgttttccgagtcttgcgcaagctctttcaatcggttcagtacgtcttcctttgtggcaggtttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagggaagattagtgtcatgagcgtccatcattgtatattagttttgggtcacaaaataatgaaataaaacgattacttcatactcttttgcttatttttttttgattatcgcatttttatgataataaaacagtaattcccatgtacagcatcataccgattatgtcatttgtgatggctataaacggacctgttgcgatggcgggatctatttttagtttctccagtgtcatcgggaccagtgtgccgaagatggaggcgaacatcacaacggcaaacagactgatggatacggaataagtaaccgtagccgtcgcaccgaaccggataaagttgtaggtatataccagcagggagatgatggtagcattgattaaggctactaccgcttccttggtcacttgcttgaaagtgtttttggcgtccagtgaactattggcaagcccttgtacgatgatagcggaagactgtgtaccgacgtttcctcccgtaccgccaatcagcggaatgtataatgccatttcggggtgtgcggcaaaggttgcgtcgaaatttcccaatatcatggagtttccgatacctccgatcatgccgatcagtagccagggcagtcgggctgtggtctgtcttagtacgttgtcatcggtttctacgtcctgcgaaagaccggatgccaactggtaatcacgttccgactgttcacgaacttcgtccatgacgtcgtcgacggtgatctgtcctatcagtcggccgatgctatccaccacggggatggcaacaaggtcatacttttcgatggtttgcgccacttcatcgatggaagtgtctacgtgtacggagatcgggtctttctgcatcacgtgtttcactttggagacagaaggggaggtgatcatcttcttgagcgggaagattcccctcaggcgttcatcgtcgtcaatgacatatacataatatatttcgtccagttcttcggcttgctgacgcatttccttcagacactcgggcatactccagttctcgttcacgactaccatttcggtgcccatcagaccaccggcggtgttttcgtcatatttcaagaggtccacgatgtctcctgcctgttcgatgtcttcgatgtgcgaaagaatttcttcctgcttgtcttcgtcgaggtcacgcatcaggtctacggcatcatccgtgtccatgtagtccacaaagcgcttggcgattgtttccgaagggatcatttcgaggaactctttacgaacgtcctcatccatttcgacgagtacgtcggccgcggtttcattgttgagcaggcggtagacaaaccgggcttcttccgggttcaggtcatcacacaattcagcgatgtcggcgggatgaaggtcgacaagaagttctttaaccttatcggcatctttttgctcgataaggtgttttacgttgtcaatgtattcctcgttcatctttttgtttacgattaaacgttttacaaattacgggtttcgctcactatcggtcagttaccggatgcggtggctgttttcagcgcttcttccacctggttggtcagactgatgaattcttccaccgacagttgttccgggcgcttgttaaataatgcatcctccgtcagcgggcagtctttgcctaaaatcggcttgatagagttgcgtaatgttttgcgtcgttggttgaaggtggtcttcaccacttgtttgaacagtttttcgtcgcatcccagttccttggtatcattgcgggtcatgcggatgacggcgcttttcacttttgggggcgggttgaaaacatgttcgctgacggtaaagagatattctactttataccatgcctgtatcagtacgctcaggatgccgtaggttttgctgcccggtccggcagcgatacgttcggctacttctttctgtatcattccggtacagcaagggatgatgtccttgttttccagcatcttgaaaaatatctggctggagatgttgtacgggtaattaccggtcagtacgaaaggctttccgtcgaacaaccggtgaaggttcattttcagaaaatcgtcttcgataatgtgatcctccagtgacggataggcttcacggagataggcaaccgattcgtagtctacttcaacgacttttaccaaccggtctttttttaccagaaactgggtcaatactcccatacccggtcctacctccaatacaggcagttcggggaaggtgtcgactgtatcggcaatatcctgcgctactttcagatctttcagaaagtgctgtccgagaaactttttaggctttactaatttcatttaccaactaaataattacttttgcagccgacaaaggtaattcttttaaatgaagaatgaagaattaaggatgaagaaactactaaaaaagacgctgaagctgatattaccgattgttttaggcggctttattctatactgggtttatcgcgactttgatttcagcagggtcggcgaggtattacggcatggtacgaactggtggtggatgcttttttcgctcttgttcggggtgcttgctcaggtatttcgcgggtggcggtggcggcagacgctggagccgctggatgctttccccagaagaagcgactgtgtgaatgccatctttatttcttatgccgccagcttggtcgttccccggataggggaggtgagtcgttgcggggtgttggcgaagtatgataatgtctcgtttgccaaatcgctggggacagtggtgacggagcgactggtagatacattgaccatttttctgattaccggtattactgtattgctgcaaatgccggtgtttgtcactttccttgaaaatacggggaccaagataccttcttttgcttatcttttgacttcggtatggttttatatcgtcctgttttgttttatcggggtggtggtgcttctttattatttaaggaaaacgctgtttttctatgaacgggtgaaaggctttgtgttgaatatttgggaaggaatcatgtctttgaaaggagtacgcaatattcctttgttcatattttatacattggccatctgggcttgttatttttttcatttctattttacgttctattgttttgcattcactgctcatttgggcattcttgcggcactggtaatgtttgtcggcggtacgtttgctgttattgtgccgactcccaacggggcgggaccgtggcattttgctatcatggagatgatgatgctttacggagtaaatgtgacggatgccggaatatttgctctaattgtgcatggtattcaaacttttttggtagttttgttgggtgtatatggtttggcggctttgccgtttaccaatagacagcgaaagtaatcacttaataaaaatagatttgttatgagtactattctttctttagctccacagaatgtgtggaagcatttttattcgttgactcagattccccgtccgtccggacacatggagaaagtgactgaatttctgattaacttcggaaaaggcttgggactggaatctttcgtagacgaagcgggtaatgtgattatccgtaaaccggcaactccgggcatggaaaaccggaaaggtgtaattcttcaggcacacatggatatggttcctcagaagaataatgatacagttcatgattttgaaaaagatcctatcgaaacttatatagacggtgactgggtaaaagccaaaggtactacgctgggtgctgataacggactgggtgtagctgctatcatggctgtactggaagcgaatgatctgaaacacggtccgctggaagcattgatcactaaagatgaagaaaccggaatgtacggtgcattcggcttgaaaccgggtacggtaaacggagaaatcctgctgaatcttgactctgaggacgaaggcgaactgtatatcggttgtgccggtggtatggatgtgactgctacgctggaatataaggaagtagctcccgaagaaggcgacgtcgctgttaaagtaagtctgaaaggtttgcgtggtggacactccggattggaaatcaatgaagggcgcgccaatgccaataagctgttggtacgtttcgtgcgtgaagcggttgccagctatgaagcccgcctggtaagctgggacggtggtaatatgcgcaatgcgattcctcgtgaggcatgtgcggtacttgccattcctgctgaaaacgaagaggaactgctgggcttggtgaaatattgcgaagacttgttcaatgaagagttctctgcaatcgaaactccgatcagctttacggcagaacgtgtggagcttcctgccggtgaagtgcccgaagaaattcaggataatctgattgatgccatctttgcttgtcagaatggtgtgacccgtatgattccgaccgttcccgatacggtggaaacatcttctaatctggctatcattacgattggcggtggtaaggctgagattaagattctggcccgtagctccagcgatagtatgaaagagtatctgactaccagtcttgagtcttgcttctctatggcaggcatgaaggtagaaatgactggcggctattcaggatggcagccgaacgttgaatcacctattttgcatgcgatgaaggaatcttataaacagcagtttggagtagaacccgcagtgaaagtaattcatgcaggtttggaatgtggtattatcggtgctatcattccggggttggatatgatttcatttggtccgacattgcgttcgccgcactcaccggatgaaagagctttgattcctaccgtacagaagttctatgacttcctggtggctacattagcacagactccgacgaaataaggattcttttcctatttatataataggtatcatatagtaaaaaggcatggaagattatcttccgtgcctttttgtcatatttgctgccattgaaattataattctgccttataacaaataaattaattgatgcaaatcaattaatatgctataaaacataaatttctttcctttttcggctcaatctataaacaatggtcgtatttttgtgttataaaacatgtaattaggaggataacaaaatgaaaaagttagaaagattgtttagaaagatcggcaatgccgatgtacatgtttggggatactcaacacttggcatactccccaaagagaagatttaagttttttagttttcaggtattagtaattttaaaggtttaaagattatggcaaagaaaatgagttcattaattagaaaaatcctcagtgaagtaggtcgcaacgaaatgctttcatgggggtacagaattgaaaaatgagattcagtacattaactaagcttgagtggggatgcgttattgaaaacgttatccccactttttattctgtcatttaggctgtatagtggttaatccgcgttctttatctttctgttttccatgttccgatagttcttgtcgcactatcaaagtttacccccacttttattattttccagtctcccacctgatagggaatggcatactccttactattaatctgcgccaatgcttcttccggtgtaccgtccactttaaattcaaagacataaagggtatcttgtaattttacaatggcgtcagcccttccgatagctgtatctacttccacatctatatattgccccatcagcctgaaaaatagatagaagatggtttggtaatgtttctcttctttattatttaacttattagggatagaagcgaagaaggactttagtctttccaggcatccatccaaatttccggcacgtaagtctttaataaatgatactatataaaatgtattctctcgtgcgggcaaatgtacataagcaggcatgagagattcgagaaatcctttcctgacttccttgttggggtaagctagggtatagagctgaaaactcgggtcatatcctttaatagtgagatagccgctttgataaagtactggaagagggtcggtaattctattagtgggagcatcaaattgttctgctgtagcagtagtgtcatccaactcacggatatcaaagttactttcttgtaggagatctatcaaaaaagtgggagtaccggtagaaaaccaaaaattggaatactttttttgtgcgaaagcattgaacagactgaatggattataaatatcctcgctattttcactaaaatgatatccgtcatattgttgtttcagatgagtacaagcttcttcatatgtttcgttattggcttgagccatctgttcgatatcgatttgcagtgtgtgtacctcttgttcggtaatgccgcatatagcgctatattcatcccacatactgatattttgcaagttgttcagttcgctaaagatactcatttgactgaatttgctgatacctgtgataaaaaggaaacggatatattggccttgcgctttcaaagggctgaagaaatcgcgcataatatcacgaatttctatttgcaattccgtattgttattactgtccagcatgggagcatcatattcatctacaagtatcacaactggtttgccggtctgtgtatatgcgcgttgtatgattccctttaaacgaaggctgaaagtcgtttctccttcttcgcgtccatataatttttcccattgcagtaactggtaattaatgacggctgataacgcttcggcagtcatatatttactcacactgaaatcaatatgtagcaccggataaacagcccattctttttccagagtttccattgccaatccgttgaacaagtctttctttccggaaaaataagcttcgagtgtagatactagcagacttttcccgaatcgtcggggacggcttaaaaaataaaccttatttgtgtttgtcaaacggtaaattaactccgttttatcaacgtacacataaccattatttcgcaaatcttcgaaattctgtattcctatcgggtatcgtctgagtctctcgtccatctaaattacatttttatatgaaacatagacaaagatagaactaaataggggaaaatcaaagatcaaaaagtatattgttgttttcttccatttttattttcgtatttcttttcacataatatactcttgttttcttcccatattacgatacattcttttagctcctcacctgttttatttctatttgtgtatatatcggtctcatggtgaaaaaatgaccttcttaaaaagggaatatttaaacagtcaggaaggcgctaatgccaacatcatataaatatagaatgaaaaagcttcggcatttgtaactatgatatttactctttttatgaattggatggttttgtgattaaattgaagctgtcttgatcttaaactggttatttggtaactttattgaaatttgatgattcattatgctattgttatcatgtttgttattgtcgataaactagagaaaaatagcctccctatgcctcttttattactttttggccagtgataaataagttcctcggtgaggaaagagtcgttggtttaaaaggaacatcccgttggttttaaaccaacgaaggttttgttggtaagaaaagatgcatatttcacgtacctttatgtaatattagtctatatttctgcatattattacacttatttatgcgaattatttgctggttcactattttttgatcaactgaatttctaatataatcttaaaaatcgaacattgctgtctctttttcaaatttggtatcagatgaaataagacaattattgaaaattaattgaaaaagaataaatctttaaacttttattccttactttgttatttatacagatatatatcaaacttaaactggaaagattatgaaaataaggcagatttgtatgctggtgctattatgtctgggagtgattccggcagtgcaggcacaaacttacgacaaattatggaaacaagtggagcaggcagaaaagaagagcctgcctgagactgtgataaaactgactggcgagatttatcagaaaggggagaaagaaaagaactctccacaaatgctgaaagcgtatatgtggcggatgagataccgggatatgctgaccccagatagcctgtatacgaacctgaatggtttggaactgtgggcaaagcaaactgaccaacccatggaccgagctgtattacattcgctgatagccgagatttattcaatgtatgcttttaacaatcaatggcaactccggcaacggacagagattgtaggtgaagctccttcggcagatatgagggagtggacagcaaacatgtttgtagagaaagtgagaacaaacgtaaaggaagcaatggcggattccgtactattgcttaacacatcttcacgtacttatattccttttgttgagttgggcgaaacaagtgaatactatcatcatgatatgtatcatctgctggctacccgcggtattgtagctttacagcaggtagcgggattggatcgtgccactccggtggaagatatttcggaagattcgtctgctgaaaaagaatcttcggtgaaacaggatattatagcaatttatggaaatatgattgctgcttataaagcatccggtttgaaagaaggctatgtgttgacagcgctcagctatttagagtggagacgtgattcagatagaaacatccgccctttcggactgaagaaaggattgtcgggattaacagaagatacctacgttactgcactgaatgaactgaaaagcagatttaaatcagagagtatttgtgctgaagtttatttggcccaggctcgctatgcgattgaaaaagaacagcaaacgtcagctttgcagctttgcgatgaggccatccgtttataccccggttatcgtagaattaacgctctgaagaatttgcgcgaagatatcctgtcaccgtttctgaatgtaactgcggctgcaacagctttccctggtgaggaaatcgaaataagagcttcgcacaagaatctggatggatttacacttcgtctttatcaggcaaagaagttgataaaggaacagcactttgcagttcttcgtcccgaagactaccggacgcaggatacggtatttacctttaaagcgccggaagtcggacaatatgtaatgcgtatcgttccggatattcgtgccaagagagacagtgaaagcaaattcaatgtgacacgtttcaaagtattgacctgccgtttaccgggaaatcaatatgaggtagtgacgctggacggacaaacgggacaccctataccgaatgcgaaaataactctttatacgaatgacgaaaaagtattgcaggaatatataactggggcagatggcaaagttgtcttcccctggaaatccgaatacagatatttgaaagctgctaaaggtatcgataccgatatgccgtttcaaagcatttacggtggaagttatggatattacggagatgaaaacaaggtctccgaaggaatgactttgttgacggatcgttctttgtaccgtcctggtcagatcgtatatgtgaaaggaattgcctatgtacagaaatctgatacggcaaatgtacttccgaacaaggactatactgttgttttgatggatgcaaataatcaggaagttggacagaaagcggttcgtaccaatgaattcggctcgtttactgtcgattttgcattgccatccgcttgtctgaatgggatgttttcgttgaaagccggcgagggaagaacgaatattcgcgtggaggactataaacgtccgacgtttgatattactttcgacaagcagcagggcagttatcaattgggcgataaggtagaggtgaaaggtaagatacagtcttatagcggtgtgttgctgcaagaccttccggtaaaatatacagtgaagcgttctgttgtcgatctttggagactggcggaaagtacgcagattgcttccggtgaggtaattgccaatgaggacggggaatttacgattccggttcttctggaagaaaataatgcctataagaataataccagaatctattaccgctactcgatagaggctactgcaaccaatgtagcaggtgaaacacagtcgtctacagatgtgatagcagcaggtaaccgttcactgattctacaaacagaattaaaagagaagacctgtaagaatcaaccgtttaacactgtatttaaggtacagaatctgaatgggcagcctgttgaagtaaaaggtacattctccctctatcaggcgaaagatgcggacttcaagcaactggacgagaatccggctgcaacaggtacatttacttccaacgaagaaatgacgattgagtggggaaaccttccttccggaccgtatgtgttgaaagctgtcgtaaaagatggacagggcaaagaagtgacggctgaggccaacaccattcttttctcccgcgaagataaccgtccgccggtagaaacgaccgtttggttctatgaggcaaatacggaatttgatgcaacgcatccggccgtgttctgcttcggaacttcgaaaaaagatgcttatgtgatgatgaatgtattctccggtaataagttgctggaaagcaagactatgaatctgtccgacacaattgtacattttaaatatccatatcaggaaagctatggtgacggagtactggtaagtttctgtatggtaagagacggacaagtctatcaggaacaggcaaggctgaaaaagcgtctgccggacaagacattgaccatgaaatgggaagtattccgtgataagctgcgtcccggacagaaagaagaatggaaactgactattaagacaccgcagggacaggctgccgaggcagaaatgctagcaactatgtacgatgcttcgctggataagatatggaataaaaaacagaatttcagtgtattctataatcagatcatcccttattctagttggatgggcggatatttcggtaataattcgttcaattactggtggaataataaatacttcaaagtaccgacaatggaatatgactattttgtgacgcagggaacgatgtcgatggaccaggcgttgaatggaatggtgccgggagtgatggtcagaggatatggcgtgcaaaagcaggcctcaatgacgggcagtatgatgatacggggcgtttcgagaagcaaggcggaagcaaaatatgtacctgctttggctggaagtgttgctgaggatgcggtatttgaatcagagttagtgtcagtagaggcaggcaagctggacggcgcatccgaagaagaaactcttcccgaagctcccgccgatttgcgtacgaaccttgcggaaacagccttcttctacccacaacttcgtaccaatgaacaaggcgaagtttccttctccttcactatgcccgaaagtctgacccgctggaacttccgcggttactctcataccaaaggtatgctgatgggcacactggacggtgaagccactacaagcaaagaatttatgctgactcctaatctacctcgtttcgtacgtgccggagataagacatctgttgccgcctccatttccaacatgaccggaaagccgcaggccggtacggtgagcatgattctctttgatccgatgacggaaaaggtaatcagcacacaaaaacagaagtttaccgtagaggccggaaagacaatcggcgtcagcttcatgtttaccgtgagtgataaatacgagatactgggatgccggatgatagccgacagcggtaccttcagtgatggtgaacagcagctacttcccgtgcttagtaataaagagcatctggtagaaacgcttccgatgcctgtccgtggagaagaaacacgtactttctctctcgacagcctgttcaatcatcatagtaagacggcaaccgaccgtaaactaaccgttgaatttaccggaaatcctgcctggtatgctattcaggcattgccttcattgagccttccgggaaataataatgccatttcgtgggctaccgcttactacgcaaatacactggcttcctacatcatgaacagccagccacgtattaaagctgtattcgatagctggaagctacagggtggaaccaaagaaaccttcctgagcaacctgcaaaagaatcaggaagtgaagaatatcctgttatccgaatctccgtgggtactcgaagcgcaaacggaagaacagcagaaagaacgtatcgccactctgttcgatctgaacaatatccgtagtaacaacattgccgcattgacaagattacaggagttgcagaattcaagcggagcatggtcgtggtataaaggtatgaccggtagccgttacgtcactacctacattgccgaattgaatgcccgcctggctatgatgacaggtgagcaaccaagcggcacggcgcttgccttgcagaagaatgcctttacctatctccatcaggaagctctgaaggaatatagagaaattctcaaagcacagaaagacggggtgaagtttacaggtgtttccggaagtatcctgcaatatctgtatctgatcgctctgtccggcgaacaagttccggcttccaataaagccgcctatacttattatctgtccaagataggcgaaatgcttccgaccgcttcgatggatacgaaagcgattgccgctatcattctggataaggccggacggaagaaagaagctcaggagttcatcgcttcactgaaagaacatctgacgaagacggacgaacagggaatgttctttgccttcaatgaaaatccctattcctggggcggaatgaaaatgcaggctcatgtagacgtgatggaagcactggaactgacaggcggaaataacgataccgtagaagaaatgaaactctggctgctcaaacagaagcagacccaacagtggaattctccggtagctactgccgatgccgtctatgccttactgatgaaaggcgtaaacctgctcgacaatcagggagacgtgcgtattgtcattgccaatgaggtgctggagactgtctctccaagcaagactaccgtaccgggactgggctatatcaaacgctcgtttacacagaagaatgtagtggacgcccgtaagatagaagtcgaaaagagaaatccgggcattgcgtggggagccgtttatgcggaatatgaatcacccatcaaggatgtgagacaacagggaggagaactgaatgtgcaaaagcaactgtatgtggaacgtatggtgaacaatgctcctcaactacagcctattacagaaaagaccgttcttcaggtaggcgataaagtagtttcccgtttgagtattcgtgcagaccgtgcgatggacttcgtacagttgaaagatcagcggggcgcctgcttcgaaccgatcggcagcgtatccggttacaactggagtaatggaatcggctattacgtagacatcaaggatgcttccaccaatttcttctttgaccatttaggaaaaggagtgtatgtgttggagcatagctatcgtatcagcagagtaggaacctatgagacaggtttggcaaccatgcaatgcgcctatgcgccggaatacgcttcacactcggcttcgatgacaattattattaaataacgcacagagaagatttcttctccaccggtgagcagggcactcgccaccgataaggaaggtgttccccaccgatgaaggttaccttcatcggtggggaactttttgttgatgaatactgcgttgcaggagttgtcacagggtaaagtattttctcaaacggtgttaatctatgtaatctgtgatgaaaaactcatctaaaactcctacatttgtggaccaaaataaaatatatcacatgaaacgtactttactattgatatttactctgcttactgtcactttggcggctgttgcccaaccccgtatttcctctaacaaggagacgcacaactttggacaaatagaatggaaaaagccggtaacagtagaatataccatcaccaataccggaaacgagccgttggtgctgaccaatgtcacgacttcctgtgcctgtgccgtagccgactggacaaaggaacccattgctccgggtgccaaaggaactgtgaaagcctcttttgacgcgaaagcgctgggacgttttgacaagtcgataggcatatacagcaatgccactccgaatctggtttatctgaaattcaccggtgaggtagtgcaggaaatcaaagattattcaaaacttcttccgtacgccatcggcaatatccgcattgaccgtgacgagttctccttccccgatgtctatcgcggacagcaaccgtctatgacgttcagtattgccaacctttccgaccgcccgtacgaaccggtgttgatgcacctgcctccttatctgaagatggaagcggaacctaaagtactgctgaaaggtaaaaaaggaacgatcaagctgacactggatgccagccagctacaggacttcggactgacacagacctctgtctacctgtcccgtttctccggtgataaagtgagtgaagacaatgagatacccgtttcggccattcttcttcccgatttctcgcgtatgacggagaaagattctttgaatgctccttccatccacatctcggagacgaatattgacctgagtattccgttgatcaagaagaataaagtcagccatgatatattgatcgctaatgcgggaaagaccccgttagtcatcagcaagctacaggtattcaactcttctgtaggagtaagactgaaaaagacggtcattccgccggacggaatgactaagttgaaagtgacgatccacaagcgggatgtaggtaataagaaacatcatttacgtatcttgatgattacaaacgacccgttgcgtccgaaagttgaaataaatatcaaacgctaactcttattgccatggaacatcctgaaaataacgaagaatataaaggactcgttgtcaataaaggcatcgaacagccctcatccgtgaatccttatttgaaacgtaagcccaaaaagcgtcagctttcggtagcggaatttgtagaaggtattgtgaaaggcgatgtcactattctcagtcaggctgtgacactggtagagagcgtgaagcccgaacatcaggctgtcgcccaggaagtgatcgagaaatgtctgccttattccggcaattccatccgtgtaggtatcagtggagtgcccggtgcgggaaagagtacctcgattgacgtattcggtctgcatgtgctcgaaaaaggcggtaagttggcggtgctggctatcgacccgagcagtgagcgtagtaaaggcagtatcctgggagacaagacacgtatggaacaactttccgtacatccccaatcgtttatccgccccagcccctcagctggttcgttgggaggagttgcccggaagacccgtgaaacgattgtgctttgtgaggctgccggattcgataaaatctttgtggaaaccgtcggagtgggacagagcgaaacggctgttcattctatggtggatttcttcctgctgattcagttggcaggtacgggagatgaattgcaaggcatcaaacgaggaatcatggagatggcggacggtattgtcatcaacaaagccgacggagataatctggaacctgccaagttggctgccagtcagttccgtaatgcgctgcatctgtttccggctcccgaatcgggatggattccgaaggtgctgacttactccggtttttataatatcggcgtgaaggaaatctgggacatggtgtatgaatatatcgacttcgtgaagaagaacggttattttgactatcgccgtaatgaacagagcaagtactggatgtacgaaacgatcaatgaacagctccgtgatagcttctatcacaatcctcggattgaagcgatgcttcaggagaaggaacaacaagtgctgcagggaaatcttacttcgtttatcgctgctaagagcctgctggatacctattttgacgaattaaaacgatgataaagcagaaacagtgatggattagaaaaacgaccgaacatttacccccgataactataccctaattaataaccaattgttaactttaacacctgatgaacaaaaccttattaaccgggcttttgtgttgtagtttgtcaatacagagctttgcagaccaaccgttagaaggattcacctatggttcggtgaatgctcctacaggaaaagagtgggaatctcccgaaaacctggcgctcaacaaagagcagccgcatgcttatttctttccgttccagcatttggataatgcccgcaaggtattgccggaaaacagtaagtattggcagtcacttgacggtgactggaagtttcactgggcacccgaccccgactcccgccccaaagatttctatcagactgagtatgatgtcagctcatgggatgcgattcccgtgccttcaagctggaatatttatggcattcaaaaggacggaagccagaagtacggaacgcctatctacgtcaaccaaccggtaatcttccagcacagcgtgaaggtggatgactggcgcggaggcgtgatgcgtactcctcctgccaactggactacttacaaggatcggaacgaagtaggttccttccgccgtgatttcgaaatcccgcaggactgggacggacgcgaagtctttatcagcttcgatggtgtcgattcattcttctatctgtggatcaacggtcagtacgtaggtttttccaagaattcgcgtaataccgctaatttcaatatcactccctatttacagaaaggcaagaacaccgtagccgccgaagtgtatcgtagttcggacggttccttcctcgaagcgcaggatatgttccgtctgccgggcatcttccgtacggttgccttgtactcggttcccaaagttcatttccgtgacttggttgccacacccgatttggatgcgacttatacggacggttctctgactgtcaatgccgaaatccgtaatctggataagaaagccatcaaagactacaaggtatattactctttatatgccaacaaactgtattctgatgagaataccttggtagatggattcttatctcctgtgatcgacaaaatcgctccgaatgaaaccggtagtgttcagactgttcttaaggtaaaggctcctaataagtggtcggctgaatttccgtatcgctacacgttggtagccgaattgaaggataagaagaacagaaccgttgaaatggtttccaccattgtcggtttccgcaaagtggagattaaggatactcctgcttccgaagatgaattcggacttgccggacgttattattatgtgaacggaaagacggtcaaactgaaaggggtgaaccgacatgaatccaatccgggagtagggcacgccataacccgtgagatgatggagaaagagattatgttgatgaagcgtgccaacatcaatcatgtacgtaattcacattatccggatgatccgtattggtatttcctgtgcaacaaatacggtatttatctcgaagatgaggcgaatatagaatcgcacgaatattattatggtgctgcctccctctctcatccggtggaatggaaaaatgcgcacgtggcacgtgtgatggaaatggtgcgtgccaatgtcaacaatccttctatcgttatctggtcgttgggcaatgaagccggaccgggcaagaactttgtggcggcttatgatgctttgaagaagtttgatacttcccgtcctgtgcaatatgagcgtaataatgacattgtagatatgggttccaaccaatatccgtctatcggctgggtacgtggggccgtgcaggggaaatatgatatcaagtatccgttccatatatccgaatatgcccattcaatggggaatgcctgcggtaatctgatagattactgggaagctatggagtcgaccaatttcttctgtggaggtgccatttgggattgggtagaccagtctatgtacaattatgacccgaagacaggtgtccgttatctggcttacggcggagactttggcgatactcccaatgatggtcagtttgtaatgaacggcatcgtgtttggtgaccttgaaccgaagcctcagtactatgaagtgaaaaaggtatatcagcacatcggcgtaaaggcaatagatacagaaaagggggtatttgagatcttcaataagtactactttaagaacttggcggaagattaccagttggtatattcgctttatgaagacggtaaaccgataatgaccggtaaaccgatggatatcaatatagctccacgccaacgtgcacagatcactctgccgtatgatcatgcctctcttaagaaagatgctgagtactttatgaaactacagtttatactgaaagatcaaagaccttgggctgccaaaggctttccgatggcagaggaacagattttgataaaggaggctacagaccgcccgtccatcagtgaagtaactgccggtgcagcaaaactggatggattcgtactggacaaggatacgaagcgcatccttataaagggagctgactttgaagccatatttgacccgcaaaccggaagtatctacagtctgaagtatggcaacgagactgttatcgccgatggcaacggtccgaagctcgatgctctccgtgcttttacaaacaatgataactggttctatgccccctggttcgaacatggtttgcacaatctgattcataaagcaactgaatataaagtactgaataaaggcaatggcactttggtattgagttttacggtagaatctcaggcaccgaatgccgcacgcattaagggtggtacaagctccggtaagaatagcatcgaagaactgaccgacagaaaattcggtagcaatgactttaaatttgtcactaaccagatatggacagtgtatccggacggttctatcgaattgcagtccagcattacttccaatcgttcgagtttggttctgccacgtttgggttatgtgatgaaagttccacaacaatacagtaacttcacttactatggacgcggaccgatagataactatgccgaccgtaagagcggacagtttatcgaacagtatacgaatagcgtagcaggtgagttcgtaaacttcccgaaacctcaggatatgggcaatcacgaagatgttcgctggtgtgcattgaccaatcaggcagggaatggagctgtcttcgtagctaccgaccgtctttcggcttcggcacttcagtactcggctctcgacttgattttggcttcccatccttatcagttgccgaaggcaggcgatacctatctgcatttggattgtgcagtgaccggtctgggtggtaacagttgtggtcagggagctcctctcgtacacgaccgtgtgtttgccaaccagcacagcatgggattcatcattcgtcctgccgataaggaactgagtgtcgttgccaatgttgctcctgcgggagatcttcctctgtctatcacacgcacccctgccggaatggtcgaattgacttcggcaaagaaagatgctgtcatttgttatagcattgacggaagtaaaaaagtgcaggaatacacagagcctgtccctatgcgtaacggaggtacgatcaaggcatggtataaggatagtaaggatatcagcagcacgatgaagtttgagaaaatagaaagcattcagacgcaagtcgtatacgccagtagtcaggaatcgggtgaaggcgatgcttctcatctgactgatggtgatccgaataccatctggcataccatgtattcggtgacagttgccaaatacccgcattgggtagatttggatgccggtgaagtcaaggaaatcaaaggctttacttacctgccacgacagaatggaggaaacggtaatatcaaggattactctattcaggtcagcatggatggaaaagaatggggagagcctgttaataaaggaacgttcgcaagggactccaaagaaaagagagtcttgtttgacaaaccggtgaaggcacgttatatccgtttcacggctttaagcgaacagaacggacaggattttgcgtccggtgcggagataacgattctggctaactaaagatagctgaatatatagaagaaaagtatcaatgggaatgtgtccccccttctaaatttatgagggtttcgacacatccccattgatgcttttctctattttatcggtatgaggaaacttctacaactcctttcccgccttctcaaaatccgccttagacttactctgcgtcacaatatacacacccagaaacacaagtgtaatggcgattcctttttcccagccgaagctcccgattcccatgaggattgctgcaatcgtagccacaatcggctgcatatagttatacatacttaccactgtagggcggagtaacttctgagctgtcatgatgcagagataagcaaggaaacttcctcccagtacgacatacaatacctgcaaaatggcaaccattggaatgctggtccattgaatgaccgaaatatcttgataagagaaaggaatataacacatcgaagcatagataaacatccatttattgatggttactgccgaatatcgctgagacagccccttgaacaccgtcagatagatggagaaactgatttgcgcaaccagacaaagcaagtcgccgatcagacttccgttaccactactcgctgcctgactgctcataataaggataagcgctcccatagctcccacgaaaatacccagtactttcttgttcgtaatcggctctttcagatagatggctgccacaatcatggtaactatcggcagagtagtcgttacgatagaagcatcaataggcgaagtcatcgaaagcccgaagataaatatcccctgattgaaaaccagagcaaagagggaagcaaagaaaatcttcagcatatcgcggtggtccacatgctcctgtttgcagaagatggaaagtatccagaatgccgctgccgcacctaccatacgaaacgtggtgacggagatagctgaaaactcttgaagtgccgatttgccgataggagacatcagtccccacataacgtttgccgtgagtgcaaacagatgtccgtgcagattcttgttattgcccataagtctgtgtataccttttaattgttacctttattgaaaactgctgcaaaggtaaccaatttgtcacatgatttgtttatatttgccttgattaaaattgaatattatggaacaacaggcagactatatccggcggatcgagatcaaaggactctgggcccgctttaatatacaatgggatttgcgtccggatgtgaatatcctttccggcatcaacggagtgggaaagaccactattctgaaccgttcggtgggatacctcgaacagctttccggcgacatacagctctccggtgaaatgaaaagcgacgcaaagaacggagtacacctcttctttgataatcccgcagcgacttatatcccatacgatgtgatccgcagctacgaccgccccttgattatgggtgacttcacggcacgcatggcagacaagaacgtgaagtccgaactggactggcaactgtatctgttgcagcgccgctatctcgattatcaggtcaatatcggcaataagatgatcgaaatgctttccagcaatgacgaggaacagcgcagcaaagccgccaccctctcccttgccaaacgtcgttttcaggatatgattgacgaacttttcagctacacccgcaaaaagatagaccgccgtcggaatgacatagccttctatcaggacggagaattgctgtttccatacaaactctcgtccggtgaaaagcaaatgctcgtgattctgctgacagtgctcgtgcaggacaacagccactgtgtccttttcatggacgaaccggaagcctccctgcacatcgaatggcaacagaaactgatttcaatgatccgagaactgaatcccaatgtgcaaatcattctgaccacccattcgcctgccgtcatcatggagggctggctagatgcagtgacagaggtgagcgatatttccaccgaagcggacggattcagactccccccgactattaattgttaatgacaacttctacatggcaacttcactacgcgataatctgacttcttcttacttcaatgctgcccacaagctgtattccaaaaaggctcgccggcgcatcattgcttacgtagagagctatgatgatgttgctttctggcgcacattactcgaagagtttgaagatgacgagcattattttcaagtgatgctcccttcggccacctcattggcaaaggggaagaagatggtactcatgaacacgctgaataccgccgaactgggcagaagtctgattgcctgtgtcgacagtgactatgatttcctgttgcagggagccacgaacacttcccgaaagatcaaccggaacaagtacatattccaaacctacacatacgctatcgaaaactatcactgctttgccgaaagtcttcacgaagtatgtgtgcaggccacattgaacgaccgttttatactggatttcaacgcttatctgaaacggtattcggaaatcgtatacccgcttttcctgtggaacgtgtggttttatcgtcaacgggatacgtatactttcccgatgtacgacttccatacttatactgccttgagggagatcagtctgaaacatccggaacacagtctggaagcactgcaacaccgagttaatcagaaacttgctgaactgaaaaaacgcttccccggttctgtcaaccaagtgaacggattgcggtcggaattaaaggaactgggactcgtccccgaaaccacctatttatatatgcagggacatcacgtgatggataatgtcgtgatgaaacttctgattcccgtctgtaccgccctgcgccgggaacgggaacaggaaattaaacgactggcggaacataatgaacaattcaggaatgaattgacttgttatcagaacagccaggtgaatgtcgaaatcatgttgaagaagaacgtcgcctataagcgactcttccactacgactggctgaggcaggacattcaggaatatctggccaaaggagaatgaataaaagggaactaactaataagggaataaactaaaagagatactattttatgaaagaagtgattgatacagtgagtgtggcattggcaaatggagatacggagaatgttggcaatgtcgtgatgcaggaggtcaaccgtacgttgctctcggcaggtgtggatgaagtatgggcggacaaaatagataatctgatcgtattgctgtttattatcggaatagccttgttggctaacataatctgccgtaaaatcattttacgggtggtagccaagttggtgaagcagaccaaagctacctgggacgacattgtattcaaccataaagtgatggtgaatgtcagccggatggtagcgcctatcctgatttatatcgccattcctatcgcattccccgagcatgcggattctgatttgctcgattttctgaggcgtctctgtctgatatatatcattgccgtttttcttcgtttcatcagcgctttgtttacggctgtctatcaagtctacagtgagcgggagcagtatcgggacaaaccgttgaaaggacttttgcagacggcgcaagtgattcttttctttataggagccatcattattataagcattctgatcaatcagagcccgatggtcttgctgaccggattgggagcgtctgccgctattctgatgttggttttcaaagatagtatcatgggatttgtatccggtattcagctttctgccaacaatatgctgaaggtgggcgactggatcaccatgccgaaatatggtgcggacggtacagtgatagaagtaacgctgaataccgtgaaggtgcgtaatttcgataatacgattacgaccattcctccttacctgctgatcagcgattcttttcagaactggcagggaatgcaggagtccggcggacgccgggtgaagcgttccattaatatcgatatgacaagcgtgcgcttttgtactcccgaaatgctggaaaaatatcgcaagatacagttgctggcaaattacgtagatgaaacggagaaagtggtagaagaatataataaggagcatgatattgataattccgtgttggtgaacgggcggaggcagaccaatctgggagtttttcgtgcctatctgaccaattatttgcgaagcctgcccactgttaatcaggatatgacctgtatggtacgccagcttcagcctacagaaaccggcattccgctggaactttatttcttttctgccaacaaagtatgggttgcttacgaaggcatacaggcagacgtgttcgaccatgtacttgccatcattccggagttcggcctgcgcgtctttcagaatccgtcgggtgaagacctgcgacggataggagtgaagatagaacactgatttaaaagatagaatactatatattttaagaacgatacatactgttaaccattattgattatgaacacacctatacccaatcagattatccgtgaaattacacctttgtccgacaaagactgtttctatattgcagaacgttataagacggagtttacctatccgattcataaccattctgaatttgaactgaactttacggaaaaggccgccggagtcaggcgtgtagtgggagattcctccgaagtgataggagattatgatctggttctgattacgggcaaagacttggaacacgtatgggaacagaatgaatgccgctccaaagagatacgggagatcaccatccaattctcttccgacctgttcttcaagagctttatcaataagaaccagttcgactctatccgccggatgctggataaagctcagaaaggactttgtttcccgatgtccgccatacttaagatatatccgttgctggatacgcttgcttccgagaaacaagggttctatgcggtgatcaagtttatgacgatcctgtatgaactttctctctttgaggaagaggcccggacactgtccagttcttcttttgccaagattgatgttcattccgatagccgccgggtacagaaggtgcaggaatatatcaatctccattatcaggaagaaatccgattgggacagttggcaagcatggtcgggatgactgatgtgtcattcagccgtttctttaagttgcgtacggggaagaacctttccgattatattattgatatccgactgggattcgcttcgcggttgctggtagattctacgatgtctatcgcagaaatctgttatgagtgcggattcaataacctgtctaattttaatcgtatctttaagaagaaaaaagattgttctccgaaggagtttcgcgagaactaccggaagaaaaagaaactgatctaatttctctgtctcctcgcatactttactagtctgtttctctattagggctgactaataattagcttagaatcgtgttgaatttagagtcttgtttcctaagatttattcttcggggggctgacatctattctccgttaggtacaaaactaatcgtctgacagttgttgttttttcgtctgacaactgtcagacgaaaaaacaacaactgtcagacgaaagtttaactatagtcagacgattaattctgtgcatgacgggagataaattcttttgatatgcggattaaatcttacgtagaagaggactaaacctcattggtaagcggattgaaacagtgtggtaagtcattgataacaagtttgtaacacgatgtaacaaacctgaaacggctatttcaaaccattgtatctgattcgtattcatattgtaatctcttgggtctacctttgccgacgtaataaaaacgtagagcgaagttcgatgaaaaaactatttcttttaagattttcagttgcagccttcttttgtttgttgtgtgttcttcccgcattggctgccaatattaagattaaaggtgctgtgaaagataaactttccaaagagcctttgattggagcaacgatacggttggtaggaactcctgccggagccgtgaccgatatggacggtaattttgaattgaacagtaccggtgttttggaaggtttgtatgatatagagattaaatatgtaggatataaaacggaagtacgtcgtaaggtccgtgtagaaaacggaaaactggcgattctgaatctggagttggagacagatgcgcacgaactttcggacgttgtggtggtagcaaagaagaatcgtgaaaatgagaatatgttattgctcgaacagcagaaggcggtcattgccgtgcaggctgtcagcgtcaaagagctttcacgcaaaggtgtttccgatgcggaaggggctgtaaccaaagtggcgggagtctccaaacaggatggagtgaagaatgttttcgtccgtggactgggcgaccgctataatgcgactacctttaacggatttgccgttccttcggaagatccggaatataagaatatctctctcgacttcttcggaacggatattatccagtctgttggcgtcaataaggcatttaatgcaggaggtatcagtgatgtcggcggtgcgacaatcgacattgtttccaaagaactgattggcagcggaaacctgaatatcggcctttccggaggactgaacacgcagactgtgacagcagactttctgaagcaggacggagtaaaccttctgggcttcgccactacaacagaacccgccgatgagaacaactggggattcaagaataagctggacccctccaagcagagcttgcagataaaccggagttatagcatttccggcggaaagcggtttcatataggaaaagacaggaatccgctctctttctttctcactgccggacataccactgattatcaatttacggatgaaaccatccgcaacacaacgacgagcggtacgatctacaaagatatgacaggcaagaagtacaccgagaatatcagccaactggcactggccaatgtggattatgatatgcagaaccgtcaccacatgagttataacttcatgatgattcatgccaatgtgcaatccgtaggagactataccggtaaaaactccatcttcagtgacgattatgataatcagggatttacccgtcgccagcaagcgaatgacaacttactaatcgttaaccagctgatgactaactggggactgaccaaaacattgagtctggatgccggtgcttcttataatatcgtgaaaggcaatgaacccgaccgccgaatcaacaacataaccaaagcggaagaaggatataccttactcagaggcaactcccagcaacggtatttctccactttggacgaagatgacatcaacgtaaaggcaggactcatctaccgtctgaaagataacgtagaagaaatctctaatatacgcttgggctatacaggccgatttgtagacgacaatttcaaggcgactgaatacaacctcacagtaggacacgcttcttccatcccctcattggataatttctcactcgacgattattataatcagcagaatctctcttccggatggtttaccgttcagaagaacatcgataagtattcggtcgccaagaatatccattccgcttatgcggaagccacctaccagtttactccccgttggattgtaaatgtaggaatgaagtatgacaatgtggatattcaggtagactacaatgtgaataaaggcggatcggaaggaagcaacacgattcaaaaggatttctttctcccgagtctgaatctgaaatacaatctgagtgaaaaacattccttgcgtctcggagcgagcaaaacatatacgctgccgcaagcaaaggaaatttctccttatcgctacgtaggtgtgaatttcaacagtcaggggaatgcgaacctgaagccttcggacaactataacgtcgatttgaaatgggactttaatcctacccccactgaactgatctctctgacagctttttataagctcatcaagaatccgatctcacgcattgaagtggcaagtgccggaggatacctttcgtatgaaaatatagccgataaggcaacagtggccggagtggaagtagaagtacgtaagaatctgtttgtccgtccgctaagcagtgcggcaaacggaatgaataagctctctttcggcttgaatggatcgtacatttatacaaatgcgaaaatgcctctggcaacggttaccaccggatcgcaactggaaggggccgctccctggattgccaatttcgacttgtcccacaacttcacgaaaggaactcatagcttcatcaatacattggtattcaactatgtcagcgataagatttataccatcggtacgcaaggctaccaagacatcatggagcagggaatgatgacgcttgacttcgtttcgcaagccaaactcaacaagtatgtctcacttacgctgaaagcccgcaatctgctgaatccctcttatcagttgagtcgcaaagccaacgaaagcggagagaaggtagtactcagcgattataaaaaaggaataaatatcagtctgggagtgtcgtgcacattttaaaccggataatgaaataagattattaactaattattaaagcaaaatgaaaagattgtttgtaaactttatgacgtttgccgctatggcaactgcactgacattcactgcgtgtagtagtgatagtgacggagatgacaatggaaacggtaacggtggaaatggcggaggaacaggtagttctatcgtggtaggcgaaaacatcctgtccggaacactgaccggtgaacagacactggatgccaaagaatacattctgaacggaacggttatcatcgccgacggcggtcgcctgaatatccctgccggaactaccatcaaggcgcgtgaaggtttcagcagttacctgctggtagcgcagggaggtaaactctatgccgatggtacggccgacaaaccaatcgtctttacggcaaataccaccagcccggtatccggatattggggtggcgtgatcatcaatggtaaagcacctatttccggttcaaagaccgacaagagcgatacggcactgacggaaatcaacaatgactataaatacggcggcagcgcagctgatgacaactccggttcgttgacttacgtgaaaatctgctatgcaggtgcacgctccacagcagacatcgaacacaacggactgaccttgaacggtgtcggcaacggaacaaagattgaaaatatctacgtactggaaagtgccgacgatgcaatcgagttctttggtggaacagtaaatgtaaccaatctgctggctgttaatccggatgatgatatgttcgactttacacaaggctattgcggtacgctgaagaactgctatggcgtttgggaaagcgactacacaagtacggaagccgatcctcgcggcatcgaagccgacggtaacatggacggtctgtatccggatcacctgcgtcagtctgactttaaggtggaaaacatgactatcgtgaataatgctgccaacactgccgataacgtagaccgtatgcaggatgtaatcaagattcgtcgcggagcaaaagctaccatcaccaatgcattggttaagggtacgggtggtgctatcgacctggttgatatgaaagacagcaaaggtgcaggaaacatagaatccagcattaacatcacaagtacattaagtctcacaggattgaagcagaacggcgaactgaatacatttgtcgaatcggcagacaatacaggtgcagacgcttctctgttcggctggacaggctataatttatcagcattctgatgaagtagccaacggttctttttcacagtaggtattacttttcgggcacggattgcacgaattgcacggttatgatttactaaaaccgtgtaatccgcgtaatccgtgccaaatcatataataatgagatgcgtttattacgcttttacctccctggctatccctgctactatcctctctcttctattatgaattatttcagatattatatgtttcgctgattttctttttcgtatatttgctattcattattatacgatcaatcacttatgcaaacaaactacgagcgatactgtaaaatgtcttctttggctcagataggatggtgggaagcggactttttggctgggcattatgtctgctctgattttctttgtgatcttttgggactggaaggagataccatctctttcatggatttccagaatttgatacgtgaggattaccgcgaacagatagtacaggaatttcgggccaatgcaaatatccataaagacttttatgaacaaacctttcccatctgtttaaaaaatggtgaagtttggctgcatacccgtctggctcttcgtgagaaaggtaccggaaccaatggaggtgacaaatcttttggcgtcatccagcgtgttgaggcgcctaaagaagtggaacagaaaaataccctccggcgtgtaaacgacctgttacgccggcaaaactatatatcacagtctttgcttcgcttcctccatgatgacgatgtagattcttgtattatggagatattgaatgacgtgctgagcctctatcaaggcggtcgtgtgtatatctttgagtataacgaagactatacgcatcatagttgcacgtatgaagtcgtttcggaaggtgtttccaaagagaaaaacaagcagcagtccattccggttaatgaaacccgatggtggtgtgagcagattctatctggcaaacccatcatactgacttccttgaaacagttgcccgaagaagcggagaatgaatataaattccttgacgctcaaggtatttgttcgttgatggtcgctcctttgatggcaggtgaccgtgtatggggatttatgggtatagatctggtcgaatcgtatcgtgaatggagcaatgaggattttcaatggttctcttcattggcgaatatcatcagtatttgcatcgaattgcgcaaggccaaagatcgtgttgtccgcgaacagtcttttttaagcaatctgttccattttatgccgttaggttatatacggatgtctgtcgtccgtgatgaaaacggtcagcttcttgattataagataacggatgtcaacaaggcctgttcccgcttctttgcccgacctgccgaaacgtatataggagtcttggcctctgaaatatatccggatttttcttcacagctcctctttctgaaagaagtgctggataacaattcatacagggaaaaggatatctttttcccgcagacagagctttatacccattggatagtttattctccggaaaaagatgaagtggtaggtctgtttacagattccacggaggccgtgaagaccaatagggcactggaccgtagtgagaagctttttaagagtatctttgccaatatcccggcaggagtggaaatctatgataaggatggattcctgattgacctgaataataaggatctggaaatattcggtgtagaaaataaacaggatgtgataggagtcaacttctttgagaatccgaacgtaccgcagcatatccgtgaccgtgtgcgggatgaagatttggtagacttccgtctgaattactcttttgaacgggcagaaggttattatcaccccgatcgtcgggatacgatagatatatatacgaaagtcagcaagctctatgataacgaaggaaactttaacggctatatcctgattagcattgataatacggagcagattgatgcgatgaaccgtattcgtgattttgagaatttcttcctgctcatatcggattatgcaaaggtgggatatgccaagttgaatctgctgaaccggaagggatatgccattaaacaatggtataaaaatttaggtgaagaagaggatactccattggcggacgtggtgggagtctatcgtaatatgcatcccgaagaccgtgaacgtatttttgatttctatcgggaggtcagaaaaggaaaccggaagcactttcagggagaaatgcgaatctaccgtcccggcaagaagaatgaatggaactggatacgtatgaatgtagtcgttacgacatacaatccggaggaaaacgaagtggaaatcatcggtatcaactatgatattaccgaactgaaggagacggagaaagaattgatcctggcacgtgacaaagccgaaatgatggaccgtctcaaaagtgctttccttgctaacatgagccacgaaatacgtactcctctgaatgccatcgtcggcttctccgacttgctcgtcgatacggaaaatatagaggaacgacgggagtatattcagattgtgaaggagaacaatgacctgcttttacaactgatttcggatatactcgacctgtctaagattgaagcgggtacatttgagtttaccaacggagatgtagacgtgaatatgctctgtgaagatattgtccgctccatgcaaatgaaggtgaaggagaatgtcgaactgatgttcgatccgcatcttgcggaatgccgcattattagtgaccgtaaccgactgcaccaggtaatctccaattttgtgaacaatgcgattaagtttacctcggagggaagtatccgtgtgggatataagcagaaaggagaagaactggagttctatgtacaagatacgggagttggtattgacgcagagagtcaggcacatatttttgaacgttttgtgaagttgaactcctttgtacacggcacgggcctggggctctccatctgccaaagtattgtggaacaaatgggcggaaagataggggtggaatccgaaccgggaaagggttcgcgtttttggtttagccttccctgttttgtggtgatgtcggaagaatagacaagaatgatggggctgactaaaaagtcagccccaaagagtcggtttcttatattccgaatgatagtttatcgatagactgatatacgatacttgcaatacccagtccgatgatgcccagtgtgcagagcgccagtccccactttgtacagcggtcgctgcggaaagtcggaatcgggttatcggaaggcatgatatacattgcttttacaatcagcagatagtagtacaatgaaatcacggtattaaccagtgcaatgaataccagcaagtggaagcccgcttcgaaagctgccatgaaaataaagaacttcgagaagaatccggcaaacggaggaatacctgccagtgagaacagcgaaatagtcatcagaaaagccattttcgggttcgttttgtagagtcccgcataatcttcgagggtaaacttctgactgcgtaatgctacgatagtgatgacggcaaatactccgagattggcagcggcatatacaagtatgtaatataccatggcggtcattccctgtgccgttcctccgattacacccagcatgatatatcctgcctgcgaaatactggagaacgccatcagacgcttcagattctgctggcggatagcgaatatattggcgatggtgatagaagcgatagtcacccagtaaagtacttcttgccagtcatgtatcatcggtgcgaatactttgatcagaattgccatcagcacaaatgctgccgaacctttggagataacactcagataggcggtaaccgtactcggtgcaccttcgtaaacgtctgccgtccataaatggaacggaaccagagagagcttgaacgccataccggtaaagaagaatacaaaagccatgatttgcaacggatttccatcgatatgagcaggaagatcatcgaaatacagtgttcctgcggaaccgtaaatcattgacagaccaaacagtaacagtgcgctggagaaaagtgcggtaaggatatacttggcaccggcttcagcggagttatggcggtatttgtcgaaagcgatcaaggctgccatcgggatggaagctgtctccagtccgatgaagaacatcaggaagtgtccggcggaaatcatgagatacataccgaacagggtggagagtgtaagtacatagaactcaccttgcttgaatgaagtatcgtcgcgtttcatccattcgtgtgccatcaggaaaacaatcagcgtgcctatgttcaggattgatttgacaaccgtgtgcatgggtacatagtgatacataccgccaaaaatgtcggcagctgtgcctggaaccagattgatcgctgtatggatggccatcaggataactggcagcatggtgttcaaaacgggtctcgtccctttttgcttgtgtgcgtccggactcatgaagagatcggcaaggaacagcaatagtaaaactgctacgagcgacagctcttcccgcatatgtagaaattgtgaataatccatctttataaattaagaattaaagattaaaaaataaaggttatgggatgagttgtgagactacagggagtacactttcaccaatcatgtggcttacccagaaaggagccatacccagtccggctacacaaacgatgaggcagataacagctacccgttcatcccaggtcgcgtctgtcagcgcaagatgatgtttgttggtgcaggtaccgtacagaatcttgcctaccagacgcaggatatagactgccgtgatcacgatggatgaacaagcgatgatggtcagtgtacggtggaatacgtcgttgttctggaaagaacctacgaagatagtcatttcggcaatgaacccgcttaatcccggcaaaccgagattggcaagaccggcaatcacataacatacgctgaggaacggcattactttcattaatccggtaagctcgcggacatcacgtgtgtgtgtacgtccataaatcataccgatcagggcaaagaacaaggctgtcatcaatccgtgggaaagcatctgaagaatggctcctgtcgcagcagtctgattcagcatcagaatggcgaaaagtaccagtccgcagtgagaaacggaagagtaagcgttgatgtatttcaagtctgtctgtacgcaagcggagaatgctccgtaaacaacggagatacctgtcagtatcaggaatatccatgaaagttcgttagcggcttccggcatcagatacatggcgatacggaaacatccgtaacctcccagtttcatcagtactccggcgtgaagcatggatacagctgtcggggcggaagcgtgaccatcgggactccatgtgtggaacgggaaaagagcacccagcacaccgaacccgaggaaggtaagcgggaaccagatacattgctgtgcaaaaggaatattatgtagctgtgctatttccagcaggttcatggtggtagctcccgaaccgaaatagattccgagaataccgatcagcaggaaagcggaaccgcccatcagcataagggtcagcttcatggctgcatattctttacgtcccgaaccccatacaccgatcagcaggtacataggaatcagcgcgatttcgtagaacatgaacatggtgaataagtcgatggatataaagaatccgaagactcccatagacaacagtgtgaaccaaaggaaatattcttttgtcagaggctgcagacgccaggaggcgaaagtacctgtgaatacaataacggcagacaataacaacatggctaccgaaataccgtcaacgcctaccgagtaggagatgtgaagcggtgcataccagagtgtatccgcacggaatagcatttctgccgtgttgccggcactgcgttctcccaaatacataaaggtaagtacgacggaggcaatcagaagtgccgatgcgccggtaaccataaccccccgaatcgctttgattccccgtgctgcccaaagtccggcaagcatcagtaaggggatgagtacgaagattgataaaaaattcataattgaattattaagttttaagtattaattcgcagcgacttgttgcgcagcttaatatctaatacctgatagttaatacttgctatagaactaacagcaggataagcgccagcgctccgcaaaggaacacgtatgcgtattgctgtacctggccgctttgaagaccacgtatctcgtcgcttgtcgtattcgtagcccatgccaggaaattaaagaatccatccactacatgacggtcgaaccatgcgataggagtcgaaatgcaacggaagatgatcttatgcgtaataaactggtatatatcatcaatataaaaacgatgataagcagctgtccacaatccattgaaccgtttggcaagtgcattggcaacaggctgtttggcattcttatacatccatgtggcaatcccgatagaaataatcgcaattacaacgcttgtgacagctaccgacagatcgaggtgaatagagtaagactccccattcgaactgataaaatgtccgaaaggaatgaatcctgcaaggcaggtaacaaccgccagaaatatcaacggaaaagtcatagccaacggactctcatgcgggcgacaaggtgccgcttccaagtttccgtgcggtgtgctatgatccgaatgggagcttgcccggggcggctcggccccccagaagatgccgtagtagaggcggaacatatagaaggcggtcattgcggcgattactgtcatcacccaacccattgcagggctatattggaagcaggcagccaaaatctcatcttttgagaagaaaccggagaacggaggaataccggcaatggcgagacaggcaatcaggaatgtccagtgagtaataggcatgtatttgcgtagtcctcccatggctgacatttcgttggaatgtactgcatggataatgctgccggcacccaagaagagtaatgccttaaacatggcgtgtgtgaagaggtggaacatggaagccatatatcccagtcctccgtggtgcgggtccatagaagtacaaacgcccagtgctaccatcataaaaccaatctgtgaaatggtcgagaaggccagcacacgtttgatatccgattgtacgcaagccacgcttgctgcataaaaggcggtgaaagcacctacccaggcaatcatatgtaaggtgtccggtgcataagcaatgaaaagcgggaacatacgcgctaccagataaacgccggcaactaccatcgtagccgcatggatcaaggcactgacaggagtaggaccttccatggcatcgggcagccagatatgcaacgggaacatggcactctttccggcgccaccgataaacatcagtcccaaagccaatggaagcatggaagcgccgccactgatcaatgataccgtatccggtgtgaagccgaatgtgccaccgtagtatccgtaaatcagaataccgataaggaagcctaagtctgcaaagcgggtgacaatgaacgctttcttggaagcggcaatggcagcaggctttgtatagtaaaaaccgatcagcagataagaactgacacccaccagttcccagaaaagatacatctggaaaatgtttgtggcaaccaccagtcccagcatagacattgtaaacagggacaggaaggcgtaataacgttgaaagcctgtctcgcctttcatgtaaccgaaggagtagatatgcaccatcagtgacacggtagagatgacaatcagcatcatcacggatatgggatcgagcagaatgcccagatcaaatcgtaaagtctcggtgaaaggaagccacgtaaaattataaggtatcaacgtggcaaatgttccgtcttccaaacgaggggcggagaaatattggaaagccgtaacgtacgacagtactactactgctcccagtatcagcgtaccgatagcacccgctgtccgatgagacatccattttcctccgattcccagaatgaggaaggagaggaagggaagaaggagtattagaattgttagttccatacagtttattttaattacttgttttattattgttcatatttatcacgatatccatccgaatggaaattgggtcgtgccgctttggcactaccacttcagatcgtccagattgcggacttgaatgcttcggaggttgcggtaaatgttaatcatgatggcgatagctatagccgtttccgcagccgaaatagcgatggaaaagagtgcaaagaaatagccttccatgcctcccggaaagagaaaacggttgaacacggcgaagttgatgtccgtggcgttcagcattaactctacagaaatcaggatagccagcgtattacggcgggtaaagaacccatagattcctgcaaacatcatgatggtagaaactaccagataatattccatgtgtatcatatctgaaattattaggttttaagtaataagtattaattccttgcggttcattgcgcagcctaatacctgatacttaatagttaatacttacttatttatctctttcgggcgatcatgataccaccgatgatacaagccagcaataaaatactgattgcttcgaaaggcaatatataaccatatttgtcactgcttaataaagcattaccaatggtgtggatgtttatttccagcggaaccaggttggtcgtttgcaggaagttatgcttcagggtgataaacaagataatcgctaaaccggcaaccatcgtaaagagtcctgccagaaacctgcttcgtttcagtttctcggcgcggtcaccttctccactggtcagcaggatggagaatacataaaggacgacgataccaccggcataaaccataatctggacagaccccagaaatgtgtaacccagcaggaaatagatgccagccgtgccgaagagcacgaagagcagataggtggctgagcggacaatacgttgggtagtcaccgtcatgatggacattgcaataataaatgctgccaaaaagtagaatactactgtttcaagtgttgatcccatatctaaacttcttttttcttttcaattactttactaccggcatgattcagttgcagaacaagcttcgtccggtcaaagacggcatgttcgaagttctggtcgaacgtgatggcgtcatgcggacaagcgttgacacacagttggcagaacatacaagctccgaggtcatattcatattttgccaggattttcttcttcttgccgtcttcagtctcgatcgtttcgctggttacggtgattgtatcgttcggacaagctatctgacacaatccgcaggctacacagcggtgttcgttattctcattgtggggcattgccagtgtaccacggaaccggtcgaacattttcagctctttccggttttcaggatactgttcggttaccttcttacggaagtataccttgatactggttttcatacccgttgccagagtgctgataccatgtatcagtcctcccaaatacgtatatttttgatctttatattccataattcttattttagaagtggaagccaaaggcaacacaacatgccattaataataggtttaccatagaaattggaaccagatatttccattccagattcagaatctggtcgatacgcaggcgtgggaaagtccatttgatccacattaagaggaacacaacgaagaatgctttggcaaagaaccagatgaagccgggaatatagtccataacagcgttgaatccgtccaaaccgatgatatgcaatggcatccagcctcccaaaaagatggtagcggccacgctggctacgataaacagattcagatattccgccagataaaagaaaccgaagtgcataccggaatattccgtatgatatccggccgtcaattcactttccgcttcgggaaggtcgaacgggccacggttacattctgcatttccggcaatgagatagatgatgaaagcgataacggcaggaatatgtcctttgaagataaaccatccgtcagcctgtccttctacgatttcggagaactgcatggtgcccatcagtacgaccatcgtcatgatgctcatacccactgacaactcataactgatgatctgtgcgccgcttcgcatggcaccgatcagcgaaaacttgttgttactaccccaaccggcaagcagaatacctaccacaccgatgctggaagcagccagcaggaagaatacgcccacattaaaattcagaatttccgctcctttattaaaaggaatacaagcgaaagtgaggaacgaggcgataatcaccatgaatggagccagattgtagaggaagcggtcggcatccttcggagtgaaaatctccttggtcagcatcttgagtacgtcgcatatcacttgaatagaaccccatttaccgacacggttcggaccgaggcggcactggaagaaaccacagactttgcgttccatgtaaatcagtacgatagccagaatagcatatagtgcaacgatgcacacgccgacagctatgcactctataaagatggcccatccctccggcataacggagagcagcatctcatgtatccagtttgttactatactaaagtcgaacatatatattttaattattaggttttaagtattaagtattaattccatgcggaatatagcgtatatcatattgcatagccggttaatacttactactttatacttaatacttgttttttatctcttgtttatcggtcgatgtccggaactacatagtccagtgttcctccgatggcaatcaagtcggcaattttcgctccgcggcaaatcgtgtcgattgcagcaacaagtggcaatcccgtagcacgatagtgcaggcgataaggcatcttgtcaccctgactttcgagaaagactccgaattctccgcggcttccttctacggcggcataataactgccttcgggaacgcggatgatcggtttcatcttttcctgatacgggccttcgggaatgttgtctatcaactgctcgataatcttcagactctccatgatttcgtccatacgtaccagataacgggcgaaacagtctccttccgtataaacaatttcctggaagtccaccttgtcatatacaccgtacggtatccgcttacgtacatcgcaagcccaacccgaagcacggcctgtacccccggtgcaaccgaatgagattgcatcttcacggcttaacactccgacgcccttcatacggctctgagcgataatgttgccggtaaatatgtcgtggtattcgtgaatgatacctctcatataagggataaattcttttacccgcttgacgaagttaggatgaaggtcggcctgtacaccaccgatggtattgtagttcatgatcagacgtccgccgcaagtctcttcaaaaatatcgagaatcttttcacggtcacggaatccgtagaagaaagcagtcagtgctccaaggtccatggcgagggcggagtagaacagtaagtgagagtcgatacgttgcagctcatccataattgtacgaatgtatttgacacggtcactcacttcgatgcccatcgctttctcgatgcacatacacaaagcgtgacggttctgatgtgcgcccagatagtcgaggcggtcagtcaatgccaatgtctgcggatatgtaagactctcgttcattttctcgataccccgatggatataaccgcagttagcatcgatcttacgaataatttcaccttcaagagaaacgcggaagcgcattacaccgtgagttgcagggtgttgcggaccaatgttgactacatactcttcttctccgaagagtttcatttctctgtttttaatcgttccgtccggattaagttctatttcctgtgttgtatcgaacgtctcttcgttagccatacaaagcggattatctttctccggatcattatctttacgcatggggtatcctacccagtcattacgtaagtaaaggcggcgcatatcgggatgccctacgaaaacaatgccatagtagtcgaacacttcacgttcgtagaagtcggctattttccatatatcgctgactgacggaatttccggtcgttcacggtcggtaacggctgttttcagtgctatccgttctcccgtaacagtcgattccagatggtagacaacgcctaaaccacggagtttctccggtgcgtctttttcgtctgctactccccagtccataccagtgaggctttcaaggaagtccatctgtttttcatttcgcaagcgcagcatttcgtcgtgtaacgctgcagggactataaattgtatttcttgcataattcttcgttcctcattcttcatttcataaattccggtttcttctcttttctgttcgttccaccaaagaatttctctattttcactttgcgttgtagttgcatcatgccgtaatagaaagcttccgggcggggcggacatccggggatatatacatcgaccggaagaatcttatctactccattcagcacatgataagacttcttgaaaggccctccgctgacagcacatccgcctacggcaactacatatttcggatcgggcatctgatcgtacaaacgtttcagtaccggtgccatcttgttggtgattgttccgcagaccatgatcatatcagcttggcgcggactggcacgtgctacttcgaacccgaagcgggccatatcataacgcgcggcacccagtgccatgaattcgatgccgcaacagctggttgcgaaagtaagcggccacagtgaattgctgcgtccccagttgacaaggtcgtccagaaccccaagaaaaacgttcgctcctccggtattaagttccttgaccaacttttccaatgattcattgtcgatgaactcatcatacggaattgattttattttcggttttttggttatttccattccaaagctcctttcctccaggcataagcaaggcccagaaccaaaataataaagaagaagagaatactaacgagcccctgaggtcccatgtcatgcataactactgcccaagggaacagaaaagctgtttccacgtcgaacatcaggaacaggatggcaaacaggtagtaacctacacggaactgcatccatgatttaccacgcgttggtataccacattcataagcttcaaacttttgtacattgtacgaacgtggtgaaatagctcgtgaaagggctattactacaccgacaaaagcgagcgctgtcagtaaaacaacaactaaaaatgtaaaattcataatttcaatagctgtttagattgaatattatatagaaataaacaattagtttctccacacccggatgaaaccaactgtaatgaattgacgaataagataatggattgtaccgtctaaatgacgatcttccttaaaccatatatataatatgtaataggatcgtaaaagtacttgggaatatggagtgaatgagtctgagacgtgttttgctggcttttgtattcacggaaataagtaatcagcaattgcacgcttttatctgtagggatgtgtgcaacatccgcatgactcatatcacaagactgggtagaatagaaataatgaagacgttcaagagcattatgaacaggatgatcctgagatacgtagcacttctcctggcgatatgtcgggggggatactctgcagttatcttccattgcttcattggaaacaacatggatcagcaaagcaagtaccagaaatagtccgtattttaagctttgtttcatctttctcttttaacggctgcaaatataggattaatattcatgttttttgcaaagtcggggttacaaaaaagtattttttaacttgctttatttcaagtccgtttttatttcagtgctactttggagaatcttcttcttttatggtatatatccgttcttatttggttaaaagatgtaataaaaagaacgatttacgttctttttgacgaattacccaaagaaaattcatttttttgcaaattgtatataacacattgatatgaaacacacactttgctttataacaatcctactgggttctttgttgaatctttatgcaaataacgagaatgattctctattgaaagttttagataaagtgatttctgagcgtcttgtgtatacagaaaagaaggaagctactatcaaagagctgaaagcaaaaaagaaggaacaaaagaccttggacgatatgtatcgtctgaattccgagattctccatcaatacgaaacgtttgtctgcgattctgcggaacagtacattaatgagaatattgagatcgctaagaaactggataataaaacctatttgctggaaggaaggctgcaactggcttttgtttattccttatcggggttgtttattcaagctaatgatattttcaaatcaatcaattgttcggatttacctagtcatttacaggctttgtattgttggaatcgtattcggtattatgaaaatttgattaaatatacagatgatgctcggtttgccagtgaatatttggttgaaaaagaagcgtatcgagatacagttatgagtatcttgtatgatgcatcggaagaatattcgaaagaaagagctataaagcttcaggatcagggaaatacaaaagaagcacttaagatactgactaaaatttatcaaaaggaaaaaacaggaactcatgggtttgcaatgatgtctatggggctatcaagagcatatcggctggtcggagagcatgaattggaagaaaagtatcttatattagctgctatgaccgatataaaactggcagtgaaagaaaatgaggctttgttgactttagccgtgaatttataccataaaggagatatcgatagatcttataattatattaaagtagcactgagtgatgctatcttctataattcccgttttaagaatacggtaatagctcgtattcatcctattatagaaaatacttatttatataggctggaaaagcaaaagcagaatcttcgtttttatattttgctcactagtttgtttgttgtggctcttgctatcactttgtattttacttataaacagactaagattgtttcccgtgcaaagaagaatctcaatgttatgaatgaagagttagttgcattgaacaagaatttggatgaggctaatttaataaaagaaagatatgtaggctatttcatgaaccagtgtgccgtttacattaataaactggatgaatataggaaaaatgtaaatcgaaaaataaaaaccggacaagttgatgatttatacaaatcttcttctcgtcctttcgaaaaagaattggaaggattatataccaattttgataaggcgttcttaaaattgtatcctaattttgtcgaagagtttaattcattgttgaaaccggaagattattataaactggataaagaccagttgaatacagaattgcgtatttttgctttgatgcgaatggggattacagatgtttcgcaaattgctgtttttttgcattactcagtacaaacgatctataattataagagtaaagtgaagagaatgtctttattggatggaaatatcttcgaagaagaggtgaaaaagcttggttctttgtcccaaaaatgattctatttggtttaccaaaaccttaaaatggttgtttgttaatgcgttgaatattaatgtattatctagaagagatgttcaaaaacgtctactttatagcctacttccaataaggagtaggcttttttcatctctatatttgcatcacaagatttttgataactgaatactaatctaaagaaacacagctatggatttttcagaattgtatcttacttattattcaaaactggttcggtttgcaaaagaatttgtaatactggaagaggatgcagaaaacataacacaagatgtgtttaccgacttatgggcgaaacgtgattctatggatcgcattgaaaatatgaacgcgtatcttttcagattaataaagaatagatgcttggatcatttgaaacataaaatgtttgaacagaaatatattgaatcagttcaaacctctttcgaaatagaaatgtccttgaaattacaatctttaaataggtttgatgtgtctgatatctcggaaggaaatgaaacggaaatgctcgttcgtaacgcaatcaatagtctgcctcgaaaatgtcgtgacatatttttattaagtcgtgtcgaagggttaaaatatagagaaatctcagaacgtttgggtatttcagtaaatactgtagaatgtcagatggggatagcactcaaaaagttaagggtaaaactaaatatcgcaagcaccatgcatactcccattcctaatacgaccaattttttcatatccaatattctgtatttaattaataattcaataatcttgttcgttcacatttagttttcgggcaacaaaataatagaaattttatcatccggcaaagaaaatgagcgaaaaaacgtctattctgccttcttcttataagaaatagtgcccgttgcctgataagtcggcatcaaaagcacctctgcaatctgaatatgcgcaggagccgaggcagcataatataccgtttcggcaatatcgtctccggtcagcgggcggattcccttgtaaaaattatcagccgcctgcttgtcaccacggtaacggaccactgtaaagtttgtttccaccatgcccggtttgatattcgtcacccgcagcggcgtatccaccaagtctatccgaagtccgtccgaaagtgccttcacagcagctttggtggcgcagtaaacactgcctccgggataggcggcatctccggcgatagaacctatattaataatgtgtccgcatccccgttccaccatgcccggaactaccagacgtgtcatggcgagcaaacctcttatattcgtatcgatcatgatatcccactcgtccagactaccttcgaactctttgtccactccgatcaccagtccggcattgttaatcaatacatcaatcgatttccattcttccggcaacgcttctagtgcggcggcagcctgtttccggtcgcgaacatcaaaaggcaacacatagacctgtattccatactctttttccagttcagccttcagttcttccagcttcgacactgtacgggcattcaaaatcaggttccatccttccttagcaaatttacgggcgcatccttcgccgattccgctgctcgctccggttataaaaacaatcttcgctttcattatgttttgaattacaatattgaatgacaaaagtacgccttaagtctcatttgttagtccaaaagtctagttaaataagattaaaccataaaagaaatcaagaatgataaaaaggaagtactttttttctgtttttgcgaacaacctttggagaaaaatgttatatttgttgtatcataatcattttaaacagtataaattatgaaaggattaaatgtattagcagcttttctgggtggtgcagccgtaggtgcagcccttggtattttgtttgctcctgaaaagggagaagatacccgtaataagatcgcagaaattcttcgtaaaaaaggaatcaagctgaaccgcaacgaaatggaaaatctcgttgacgaaatcgcagctgaaattaaaggagaaataggagaataagtaagtaaaggactaaaacagagcgaccatgtttgcagacgataaaagtattgagaactttcaacagttgttttttgagttcaaaaagtatctggaacttcaaaaagaatacaccaagttagagttgacggagaagctgaccatacttctttcaacgttaatcatgattgtaatacttatcatccttggcatggtagccctgttttatctgttatttgccttggcttatgtattggaacctctggtaggcggacttatggcaagcttcgctatcattgccggcatcaatatactgattatggctttagtcattattttccgcaaacagcttatcatctccccgatggtaaacttcctcgctaacttgtttttaaccgattcaaaataaatgaagttatgagtgcgcaaacacctgccaaaattacattagaagagatcacccaacgcaaaaagaagctcttgaatgaaattcaggctcaaaaaagagctatgacggccaccacccgcgaaatattctcgcctcttgcacccgctgccaacaaagcggattcgctcatgcgttcgttcaataccggcatggccatctttgacggagtagttttgggtatcaagatcatgaaaaaaatgcggacgtactttagaagactaagatagcaatccgggtatgacaagaaggatcagacccctaccccgtcccatctcatcactaccacccattctgccggctgtccgtttccgtaaagccgatgtggaatcgtaccgatcactaaatcacaatgggctgcaaatacattcttcaattccttcagcagtgcattcaacagaatttccagatgtatctcatccatgatacagctgacgacacgcacgtactgataaacgtgtaaatccttcccctgccgcatggcactcacatcccttccggagatatgcaactcatcttccagaaaagaatacgaaatcgatttgtcgatattcatcaggttcactaccatacttcccaaaaattcataaggtccatgattttcttttgtcatgtttactctttgtttaaaatttaataaaaaatagatatatatttggttattcaatctgtttcaacctatgaaacaagttctaattccccctcctttacctttgcacccgctatcccgatagtgggatatacaatcataaaacatcaaaatcaaatgcaagtactcgaagaaattaaagtttccgtttacgaaaatgtgtattccaaaaagcctaaaatcatgtctttcctcgaagtcatctttatgtgtattcatccggtttatgcttccatcatccaatccatccggcggtatcatcaggaaggcgaccatgaagccgcccaaaaactaaaaagccagctcccctgcttcactcctgccggcaccttcgacggagcgcatgccatccgaaatttccagttgcccagtcacattatcggactcgactacgaccacgttcccaatcggctggagatcatccgtctttgcgctgccgaccctcataccgtagctgctctggaaagccctacggacggcgtgaaaatcttcgcctatgtggaaggcatcgaaggccgtcaccgggaagggcagttactggtcagccgttactacgaccagctgaccgggctcaccagcgatcccgcctgtaaagacgaaagccgcctgtgctatttcacctattcaccggacggatacgtagccagtctctatcagtcattcgttctggaagcagctgtggaaacacaaccgttccagccgacagcagaaaacctcccctctcctccgctacctgcaaaagcaaacgaaacctccgagaacttctcggaagaggaagtcagcttgttcctttcgtcctacattttcttaaatccattgaccgccgggcaacgacacaccaatctgtttaaactcgcctgcgaagcttgccggagaagatattcgcaagaaagcatattacgcgggattacggtttattttgagcactccgactttcccgcacaggaaatcaggagcatcctacaatctggttaccaaaaagttacctctactccatccgtctccgcctctccgctttgctcttctcttcataaggacaaaatgacaaaagtgacatatagcccatccgaaaacgtctatgaagcagatgaagcgtattggcaaggcgaagaattcagaaaagaaacgccctgttttcccaaaagcgtgtacaaatatctgcccgatctgctgaacgaatgtatcctcgaagaggaaggtgatcgtgaacaggatctttcctttctctccaacctcaccgcattgagttccgtactgcccggcacattcggcatctataatcacaaaaagtattctccccatttctacagtttcggcattgcccccgccgggagcaacaagagcattgcgcaaacaggacgttatctgctggaagaggtccacgactggatactttccaatagcgaacttcagcagaaaatttataaccataagtacacccaatggaagctggactgtacttataagaaaaaggcacatgaagagtgtcccgaagaaccggaaaaaccagcttacaaaatgctttttctccctgccactaccagctacagccgtatgcagatccaaatgcgggacaacggtccgcaaggaagcatcatattcgataccgaggcgcagacgctggctacagccaatcatctggattgcggtaactttgacgatatgctccgcaaggcattcgagcatgaaaatatcgattccgctttcaagatcaatggcttaacccccatttatatccgttttcccatgcttgccatgttcctcaccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttcaaaccgctggcacatcgtgtcttcgagctttatcatttctgcaagaatcatcctgtattgtttcacttcagccgttctcaatgggattatctgaatcatacgttttctaagctgcttgccgaagtggttctggaaggtaacgatgaccttcaggccgttgtcaaacggtatgcctgtcttgtgatgcgcatcagcatgatccaggcacgcatccgccagttcgaggcgaatgatggcgcaccggatatctattgtgaggatgtagatttcgagcgttctctccagatcgttctctgctgttatgagcatagcaggctattattgtcttccatgccgtcttcccagctccatccgttgaaagatccgaacagtacacggaagttcatcggcgagttgccagaaacattcactaccgaagatgcaatgcagatcggcgtaaaatacgatttcagccaccgcaagatcagcaggctgataaaatcgttcattggcgtcaaaatcaataagatatctcatggaaagtatcagaagatctcataaaatagtcctatctgtcatttttgtccttttgtccttttgaagactctctgaaaacattgggaagtttgaaaaaaccttctcaatgatcggatgcaaacattgggaagattcaatacaatcttctcaatgttttttccttttatcagtgcgtctgtgtgcgtcactgcacatcacgggcacttgcccatgtagtatctttgttgtgtaatcggttacaggtaataagtattaagtaataagtattaagtattaaaaattatggcacagaattatgttgttatggctcgcaagaacctgttgaaacctagtgaagctcccaagtattatgcagtggcacgtagcggacggaaagtgaccgtcaaggaggtctgcaaacgtattaccgaacgttcgtcttattcaaaaggcgagttggaaggttgtatcggagagtttctgctcgaaatcgtcaatgtactggatgaagggaatatcgttcagatgggcgatctggggaatttccgcatgagtcttaagacggcaacggctaccgcaacggagaaggaattcaaggcatcgtgtatcgagaaaggtaaagtgcttttctatccgggaagtgatctccgcaagttgtgtaaaacactggactttgcactgtataagagtgacggtaagcccgattcgggagacgaaccgttgccggacgatggtaagggcgatcagcccggcggtggttcaggtgacgatggcgatgaagctccggacccgactgtttaatcaatcattatttactattaaagattaaaattgtatgaaaaagcaagtttggaagaatattcttcagttcattgtgacaattgcaacgtctatcatttctgctatcggggtaacgtcctgtacggctcatctgtaatacatccgcatggaaagttctaaagatgagtatctcccgagagagattaagttgttggtgattcattgcagcgctacgcgctgcaatgtttccttccctgtagaacggcttcgagaatgtcatttgcaacggggttttcgtgatattggctatcatttttatatcacccgggacggagttcttcatcattgtcgtcccgtctccgaaatcggtgcccatgtgcgtggatttaacaggcatagtatcgggatttgttatgaaggcgggctggatgaaaatggcagaccggcggatacgagaactacggcacaacgctttgctctgctcgatctgttgacgattctcaagcatcagtatccggaggcgcagatagcaggacattatcagctgagcgctacgatccacaaggcatgtccttgctacgatccgagaaaagaatattcaggattataaaaaaactacgggagatggcgaaagtgctgcctcccgtagtttttttgttgaatgaataaaaaagatttggggttacaaatctcccggcttacccaaatagtaggtgattaaccttacttcccgcacagaaaaagctttcgttttcggatgaaaatccgtagaaagtatctcatccattaatggttgacatctacgcatccagcgacgaagtttatttactgaagcgcgaacagttatatcagggaaatacatttgggctaagtcttgtttattgtagcatttcactacaaaatcaggttgattcattgtatctttatgcttggtttataagcaataaagatacaaaattattcacccatttcctacgcttttttcatattttatttcaaatttactagtcttttctttcacttttggtctgaccatatccatagccgtaaccataacgtttaccatatccataatgcttgccatacttaccgtagccgtagtaataaccgtattttcgcttcttcaggtctacgccgttaatgacagtacaaagattaggcagcttcttctcaaaagacagttcattgatcaatgtatattccgccttatgagtgtagtcagcacggcatacataaactgacaagtctgctacacgacctattaataaggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtcaccatgccgataggagcagtatcaaggatgacataatcgaagttcttcttcaaagtttctatcgctctgtccaaaccgttacgggctaacaattctgtcggattaggaggaacagtaccacccggaagaataaacagattcttatttacatcagaaggctgaacaagttccatcaaatccgtttcaggattggaaagatactgagtaatacctctctccttattagagagctggaatactttattcaaccccggcttacgaatatcgagtccgacaatcaccactttctttcccaaaagagaaagactgatagccaaattcgacgaaacaaacgattttccttcaccactgacagttgaggtcacaaggatcaccttctgatcattatctagcataaactgaagattggtccgaatattacggaaagtttcactcatcagattattcttgttctcgaagacagcgatagagccattcttatcattcttctcatcagttaatggaatatcaccgacaacaggaacactcgttagtttctccacatcggcacgaccttcgatcttgaatttcgtcagttcaatcaaataaatgatgccaaccggaattccaacaccaagcatcaatgcaatcaaatagatcatagagcgtttgggggataccggaatatcgtcagctatcgcttcatcaatgatcttcgcattattcgcagtggcagcaagcgcaatagcattctcttcacgtttctgtaacaacatcagatacaatcctgctttgatttcttgctgacgggcaatacttacataagcacgttcctgtcccggagcgttactgatacgacgagaatagcggctcgcctcacggtcaaggctctctttggtgatcatcaacccctgcaaggttccttcaagagtagcctgtacattagctttcatagcacggatactcgtatccaagttaacaatagcagggttattctctgttgatgtacgcagcaggcgtttacgctcaataagcatttcgttgtagcgttcaattgctccgatcaaagcagcatcctgtaaacccacattgctcggcaatacttcgtattcattgcctctcagatacttgcgcaagtcattcaccaaactgatttgagtacggttctccacacttttcttttcatattcagcattaccagccaaggcaatctgagcttcactcgacaaatccgttataccggcatcacgcttgaaagtttctaaatctgcttctgtacttcccaattcttttgaaataatactaatacgttcatcaataaattcagctgttttctgagcaatttcgtttttatcattattcgtattgcgattatacatctccagtaattggttgataaaatcctgcccacgttgcaaactagaattttttaacgaaatcacggccacagaagtagttttagaagtaggtgcaatagacagactgttacaatatccttttgccactctcatcggtttgttgatagtcgcagttatatgacgtacgttcttctccatccgaggaactttcgtcccatcctgcaaagctaccgaatcagcttcctgaaagaaagccaacgtaccctcatcagtcgggaagatagcaggcagcttctcaaaatgcttctgatatcccttctcacctatagtaacatttacatccatactacctttaggctgtagtgtcatttccactaccattggagaacttagtttctcagcctcctgaggtgtcaaacttacttgtaccggagacgtcttatacaaacctttagcaggaaaatcatcctcatctgtataagttatatacaggtttaattgattaacaacctcttttacaagtgttttcgaacgcaagacctccagttcattgtcaatattcttagaagaagtcatcaccccacttaaccccatatcctccaattccgaggaaagtccggtacctccgcctttcttctcatcttttatcagaacagtggctgaaatattataaataggagtagcccagtgcagataaaaccatgcaccaacaagacataacaacactgcccctataaaccaaggccaatgaataatatatttaaaaagcaatgcccggaaatcgatctgctcctcagctatttgacgttcctttccattttgattttcttccttcataactctccctttctattttaaaatattaaacaacaaactggcaatagagacaaggatggaagtagcagagaaccaaaggcttgtactgtttccgacatctgaatttcgtgctttcgccttattgggagtcacatagatgatatcattctgttgtaaataataataaggagagagaatagtccccgctttattcagatctaacggaataatttcctgctttccattagcattctcccgtattaacttaacatcatcacgtagaccgtatacagtcatatcaccagccatagccagagcttccaagatgttcactttctcattggaaatcgtaaatgtaccgggacgggcaacttctccgatcacggaaatcttataattcaccatacgtactgtcacaataggtatctccttaatataaggtttcagtttttccacaatcatctgttcagttgctttcttagtcagtccaccaacatgcagttcacccaatactgggaaattgatattaccgtcattatcaaccagatattgctgcagaacaggctgggtggttgtagaacttaaattggtattaccctgcgtagctaccgtcagattgaagggtgccgccagttcaggactagtacacgatactacaatggttaacaaatcctttggcataatcttcgcatcatacagctgtgcgtcctgagtactatataataccacttcagcatcctgcaaataaggtacttttttgtaagactgacaggctgttaacagaaaagccgccaatacgtaataggctagttgttttattctcttcatatatttctattattttttattctatctttattaaaactcaatcactttttatctgttgtatttccaaattcattatatgccccgtcttttgcttcaaaaataacagaaggctctataacatttatcgtatgccacgcccctgcaggtatttggataccgaatttaccttctgcaggagacagtacttgacgtgaaacttctttaaaacttttttgtcttatcacatcatcacaacaggaagttgcctcatgaacgtattcattcacttcttcatagataatttcttctaatttacctacaagacatattacagtttccgccgtcttttcatgccgatgaatagacacttctgtttgtggttgcaaggcgttgagcatacgttggctggtgtcggcagatgaagtacgcaagtcgaagttctgacgcaaacgtggattctccatagcctgttccaataattttcccaaaaattctttatcaaattccataactattattttttcaatgatgcgagatattcctcatgtaaatggtagtattttttcataaacaagatgtaagtaatagttaatacaaccaatgtaataaccaaatacagccagtgagcaagcactgtattgggacagagataaataaatccaagagaaatcaataactgcataaccatatacagagatgtcacctttacatgtccaatctttaattcattagccataatctgataggcgtgcttacggtgtgcctcgcccaaattctcgtgcaacataatacgatgtgcaatagttagacaaccatccacaccatatactaataaaaatatcagccaagtaatatccgtagtcttgattatcacattacccaatagaaacagcatgataaaggcaatgccgatagagccaacatccccggcaaaacatctagccttacctcgcggccggaaattgaaaaaacaaaataccagtgaagcgagaatcgtagatataatcaaactctgttcaacaaaaacgccattcatatttaccaatgccaacgtgaccaatacagctaaagcatatcctgccgtaataccattgattccatccataaagtttattacatttgtcgcacccacatatattattagcgacagtagtattatccaccacattgaccaatgcaatatatccaactgataaaaagccattgacgcagctacaaactgtgccactaacctcactgaatccggtaatgaatgaatgtcatctacgaaacttacgcctgccaccaatgttagtcctgctaaaaaccaaggatattggaacccgaagaacgcactccaaacccatgcattgatcaagaagagtatgccaccaccacgcaatacaatcgtagagtgcgatgaccgttcattgggtttatcaataatattacacttatccgcaatacgaaaatagacgatttctacaacgaaaagtaaaatgaatataataaaatatgttatcataaaatataatatcggaatatatctaatagtcgtccaattttgacatatagcgcacggtaaagcgcttctcagtacaatctacacaaaaacatcaaaatggacattgatttttcaactttatttcacacctattattatcggtaagagatttctataatcccaacatcacaatactatttcttttaaaattttcttgcagaactccaaaactgaggtactgttaattctactaaaggtacagaagaagaacttttcttatctactgttgaagcaatagtaggaatacccttcacttgtactgatactaatttataatgtatatccttgtaccatttgtaacacaaattatagtagcacttcattgcgtatgcaaaaagattgtaaggactctccctggggactacttccactttattggggataaataagtttttaaaatcagttgaactatatataatgttatcgttttttattcgatagcgaagacctacattttatgattctaagtcaagatgacaaaattggacattttcaattcgctatatcagtttgcctaataatttcacaaacgctttttcgcttagcactttgtcacttcatccaaatatgccttcacaacaatctggcggtcaaactcccgttccaccttctcgcgggctaccttgcccatggaggctttttcttcaggtgaaagctgaatgaacttttcaatctgacgagcaagatcttcaccatctcccgtattgaagagataaccggttttaccatcatcaatcacatccatagttccattgatctttgacccgatgcatattcttcctgtagcagatgactcaagcaatacattaggaacaccctcacctccatgagaaggcagaatggtacaatggcacttctcaatccattgatcaatatctttacggaaaccgatatactctactgaaccagtcttctgagcttcctctaccaacttcatatactccaactgctcattccaacctgcaatgtagaactttgtatttggatactttttcttgacaatctcagcagcttgcagatactgatctatgcctttaagtttcattacacgaccgatgaagaggaaacgaatttcgtcaccctccggtagtggcatgaatacatgctgctgaagattacaacctgatcccgggagcattgcataattctctcttatgagaccttctttaatgaagaagtctctatcacccgtattctgaaagaataccttataacacttcttgatacttagcttataaagtactttacaaatagtgctaacaatacttctcttcaagaaggtttcccctgttcctgtaatgttacatacctgcttatactttccgttgcttgctatagtaccatagatatttggtttgatagtatagctgaagataatgtctggattcaccagtggaatcatcttcttatagaagtaaataagcttcaaatccttcattggatttactccacggcggtcaatttcagtctctacaatatggcatccaaggtcttcaaaatacttgttctcctcactcttaggaagtgaaaggtatagttcatgaccttttttcaccatctcttttatcatctccttacgaaacgagtaaagagtaataaagtggtttgccaaaaaaaggattcttttcttctccattatttgtgcatttctgattattcaattgttttaatcactcgacaaggattacctactgctacactattgtcaggaatatccttcacgacgacgctaccggccccaatgatgacattattaccgacaatcacacctcctataatggttacattcacaccaagagtaacattatctccaatcaccggacggttatcattatcaccatctgctttattacccagtgtagtaagatgacgacatgagaagttcttaccgatgctcttcgcgttaatctcacatgcgaaaggatgggcgaaatacgcaccttcaccaatctttgtagtcttcgagataacaaaagatctatcacctagtctccaccaaccgattaacgcacctactacagcaccaactctatggtagaagagattgcggaaatagcggtcagtatggatgtagtacaagaacatcaagcacttgttcattcggacttcgttcttctctttacgtctctccagatctgcattgatggattttctcaaactatttttgaagagataaagaaaaatatgaggaatatatagtccaaaaaagaggagagagaatgtcaatctacctatatcacgaatctttctcttgttcatattatttaaagatttgttcgaatgaatttctgtattcacgataatcaaaaacagtacagtttttacaggcttccttcatttggataatttcgcttggagagagtttcgagattaacccaaacacatcatccaacgagtgactatcatctaccacaaaaccgttctttccatcctttaaataatcactgatgttgcttgtcaatgtcgcaatgactggagtacagcatgttatggactccacaaactttgttgggaaaccagcattgttcttaaggttgctatctctaatcaagaactgaaaatctgcatcttgaacagctttcacagtctccgtatgtggcaagcgtccatggaaaagtatattcttacaatccttcggtaactctccatacccagacacatactgcccttctgtcatgccaatcacgtcaaactgcatattggggaacttcacgatagctttggcaatggtatctagcctgtccttcacaccaaatccggcactgcccgcatacactagtttgattttatcgccagcagacaactctcgttgacgattccattttcctgcagtcagatctactgttggtggcaccaaaatagtgttcgtatacttcttgtaatagtcatataggtatcgactaatagcaatcacaccatccatcttcttcacacaataacgcattcgaaggttgatatcaatcttcctcatcatatcacttggactccacctgttattactttcccattcagtcaagtcgtgaaccaccttgattccgtgcttgtgacaagccttcagaatcttgagagacgctattgctgggaaattatagagaactacataatcaggttttctgccaagaattatcttaatactgatgaatgtgcaaatctgatgtatccattgttttattcctataggataaggtacaggagtactcacaaaaccatctacaacagccagtgcattcttgatgtctttcgaaataccaatgaatgagacttcaaaacccatctcgcgcaatagttttgcatttgccaccacacgttgtgctgcagcatttttgtccggaagttcaaaacctccgaggtatagaactgttttcattgttattgtcttctcgttacacgttattaagcaatgatttgaactgctctttcactatagcattattatactcgtaatgcgaaatactttcttttgcagcttgatatttattcggatgtgacagcagatcaaatattacatttccaatctgttctattggtgttataaaaccgttcactccgttatcaacaaattcttgcgctgcagggaagtctgttgtcacaactggtacccctaatgtccgagcttcagccaaagtgtagttaaaagtctcagatgatgaaagacatcctaataatcgacttctttttatataaggataagggtttggatactgacctgccaaaattacagattcttcaaggtgatacttcttaatttcactttgaagtaattcatattcttttgtatctgctatacctcccacaatgtgccatgtgatattcaatcctttctttcttatctcatcagttattgaaggaatttttgaaaatctctttattggatcaatacggccgacagatattacatcaatgctatcatgtctcttctcgggtattttacattctgattgattttttacttgattaacatctaatccattcataaccatatggagcttacttttttgtgaaggatcggtgcgaataaaatcatttttggccgtatttgacacacacactattttatcaatattattatatgacttaatgttcgttttactttctaaccctataaggcgactatagatggaatgtatccaagcgattttaacttttgcattagtctgcgatacaaagtatgtagcataaccctcttgaaaaccaataactgcatcataattgctgcaatccagtctatttgccattctcttcaacatcatcggggcaagatcaattcctattttcgacaaaaaatccttccctaatttcgcaatcacccttttctttggttgtccatatacatcaccttggatggtctgtgactgtggcttccgtttatctaaaacattagcatattttcctatgaaatcataagcatccccttcgttgacaattgcttttactgaaatgttataatcagaatgaaccaacaatagaagatttttaaacgaggtcatcgtacctccatatctgtaagatgggagtataaaaagaatattgttcatgggttatatctaacgttgattaagtgtctgaattttaaaagaatttcccccgaaaaattattaaacattcttctgaaacaccaattattcaggatattgatgctaatttatgcagaaatatattcgactattaaatcgagttcgaaagaaactactttaaaattgtatcataaaaaaaattctccatcgcctcattttaagaattattctacctatgattaatatttaaatccaattctgtcagcaatcttttaatatacattggctgtatcaaacgataaatataatatagtatcttcatggggagtttatttttatatatatgcaaagatacatgattattggtaaaaaaagcagtaggatacaacataatctttgcgattatgttatttttgtcttctgttatagacagataatgatatgatacgtatactacatactgccgattggcatttaggacagacattttttggttacgaccgcgcggaagaacataaggcttttcttgattggctggccgaagaaatccgacaaaacgagattgatgcattggttatagccggagacgtgtttgatgtttccaatccttctgctgcgtctcagcgcatatattatgagtttatttatcgggtgactgcggagaatccgaaactgcaaattgtgattgttgccggtaatcatgactctgcggcgcgtttggaagctcctctgcctttgttgcaggcgatgcggacggaagtcagaggggtagtgcgcaaattggagggcggagagattgactatgatcatttgacaatagaattgaagaatagagaaggggaagtagaagtactttgtatggctgttccttttttgcggcagggagattatccggtagtggagacagaagggaacccatatatggaaggagttcgcgaactttacgcgcgacttttacaaaggttgtgggcacgccggaaaacgaatcaggctattctcgctgtcggtcatttacaggctaccggatcagagattgccgagaaggattatagcgaacggacagtgattggtggtttggaatgtgtatcacccgatactttttcggaaaagatagcgtatacggctttaggacatatccataaagcacagcgggtatccggcagggagaatgtaagatatgccggaagtccgattcctatgtcttttgccgagaagcattatcatcacggggtggtgatggtgattttagatgaaggctgtgcggttgatatcagaaggatagagtgtccacaatccatacctcttatcagtgtgccgggtggagaggctgcttcaccggaaaaaataatagaaatattaagagatttaccggaggtggatggagaagctccttatctggaagtcaaggttttgcttgaagaaccggaacctatgcttcgtcaggaaatagaagaggcattggctggtaagaaatatcgtctggcacgtatcgtttctgcttatcgtcaggaagaaagagtggaaaaggaggttgatggctggaaaaagggattgcaggaaatgtctccgttgcagattgcgcaatctgcattcgaaaaggtttatcaggcggaaatgcctgccgacctgactgatttattccaggaagcatatatttccgcaactcgtaaagaagaggaggagggagaatgaaaattatagcaataagattgaagaatctgacttcgatagaaggcagtgttgaaatagattttacgatggaaccgttatcttcggctggtatatttgcaatttccggtgctacaggagcgggaaagtcgactttgttggatgctctgtgtctggcattatatgacaaggctcctcgttttgcggcttcggtggagagtatcaatctggcagatgtgggagataaccagatcaatcagtcggatgtgagaaatctgcttcgtcgggggacgagtgacggatatgcggaggtcgattttcaaggagtggacggacatcgatatcgttcccggtggtcggtcagacggacaaggaataaggcgagcggttctttacagcctcaagtgctggaggtgaaagatttggatacggaaaaagaatttcagggaacgaagaaagaattgctggcacagttggtagagttggtcggtttgacgtatgagcaatttacccgtaccgtattgctggcacaaaacgactttgcaacttttctgaaatccagaggggcggcgaaagcggaactactggagaagttgacgggaacaggtgtttattcccgcatctctcaggagatttttgcccggaataaggctgcacaagaagaggtgacgatgattcaaagtaagatgagtgtgattgagttgttgccggaggaagaacttttaaccttgcagaatgagaaagaacagttggttgagaaacgtgcggcagggattaaattgctggcagaactgaatgcgcaattgaatgtggtccgttcattgaaaatgcaggaagctctttgggtgaaaaagcagcaggaagagcaggaggaactgaataaacaaaagaatctacaggatgctttggttgttcaggaagaaggactgattcattttaaagcgcagtgggaagcgatacagccggatttgaaaaaggcacgtcagctagatgtacaaatacagtcgcagcaggcggggtatatacagtctcaacaaattttgcaggctgcccgtcagcaggtggcggatcaggagaagaaatctgcatctgcgatagagcagttacggatctcctatcattctttgagtcgtctgttgaatcgtacagatgtggagtcactgcagctggaacagattgaagtcatccttaacgaggaaaaggatacattggaaacatggacaaaagtgaatgaagaacgccttggccggttaaattctttcggttatccttctttggtagatgagcagggtaagattcaaaaagaactgacgcgcttgcagaatataaagaaattgactgaagaacaatcgaagtcgaagcaggatatagagaaactggaaaaggaagtgactgtttgtacacagcagttggcagagcaggatactgtagttaaagccttgcagcggctttatgaaaatgcccgtatggcggtaggaaaggatgtgaaagcattgcgtcagcagttgcaggaaggggaggcttgtccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaacgagacttaacccatcaaagagcaactgaggtacagataaaagaacagttgtccgttttgcaacaagaaggattgccggctggagaggaagatcagatacagaatcggttaaatgagttggcggaacgtatttcagcttatcagcatctgtatgcggaatggcagcagaacgatgagaaaataaagaaattgcggacatactgtgatgctctgcgtgagaatgtctcgcagtgtcgtttggctgcgcaaaaggtatcagccgctaaagaacagtcggctattttacagaaagcagctattgatgagcaacaaagattcgaagtgatcgctaaagcgttggatgcactccgacaggaacgttctttgttattaaaagggaagagtgcggacgaagctgaggctgctgttgcccgaagagaaaaagaattgaatgaggcgttggaaaaggctcgtaaacaagtggagggagtacaaaatcatctttccggtctgcagggagaaatgaaacaattgtccgttgtcattgaagaacttcgggagcaacagaaaggtatcgaacttccggatcagcttcctcagactatagcgaaacaacaggaagataatcttaatacggaacgtgcgctgtcgattgcggaggcacgtctgttgcagcaggcaaagaataaaacaatctttgagcagataaccaaggagcttaccgaaaagcaggcagttgccgtacgttgggctaaattgaataaattgattggtagtgccgacggtgcgaaatttaaagtcatagcccaaagttatactttaaatctgttattgctccatgccaacaaacatttggcttatctttccaagcggtataagttacagcaagtccccgatacactggcgcttcaggtgattgattgcgatatgtgtgatgagatacgtacggtatattcgctttcgggaggtgaatctttcctgatttcactggcacttgcattgggcttatcttcgctttcgagcaataatctgaaagtagaatccctgtttatcgacgaaggattcggctcgttggatgctgacagtctgagaacagccatggaagctttggagcagctacagatgcagggacggaaaatcggagtcatttcccatgtacaggaaatgagtgaacgtatttcagttcaggtgcaggtacataagaagatcaatggaaaaagcgtgcttactgtcgtagggtaagcaccgttatttccggccatgcaccgaagcggaaaggaagtccgacatagccgatgccttcatttacgtacaaaccacgtgttccttccagatacatcccgctccattcgggatagatgtaagaggaaggagaatgattaccgaattttaactgcatggcgtgggtatgccctgccagcattaaatcgatgtatgtttgtggaagtacttcccgtctccagtgggtagggttatggcttaaaagtatctggaacattccttcggttccccgcatcgcttcggggagatcagcatattgggagaaaggcggttctccttcgttttcaactccaataagggcgatactgtcgctgccctgaatcagaatcgtatgagaattattcaataacttccagcccatagcggcttgtctttgcagaagatcgttcagattatcatcttgctcatctttgcttttccagtggaaataaggaccgtaatcatgattccctaaaatggagtagactccatctttggctttcagtccggccagtatatcttgaaaatcattcagttcgactgcacgatgattaaccagatcaccggtaaagacgataagatcggcctgttgctcattcaccagttttactaacttctgaatagcggaagcatttccctgccaacttccgatgtgaatatccgacagctgaacaatacggtatccatcgaaagccgatggaagcttgggcgaggaataagttacctctttgacgtcaaactgcgtgcgtccgataaaagacccgtagatgatcattacgatagaaatcacggctaatgtcagtccggtacagataaagggagttcggggccaccgtagccatttgtggaaaggtaccccgataatcgtgcagagagacagcaatagtttaggagccgtaaacaggaagaaaaagatggaaaaccatccaatagcctgtgtatggcgttcggcaaaggcgttattggagaagtaaaccagataaagtaatcctgcggatagcaggaaagcaggcagccagtagaggattctcagccagcgttttgccgtcagatgaacgataaatctgagatacagataaatgtccggtagaataaggaaaataagtaaaaatataaataggcgttgcaacataacagcacggatattaaatttttagttgaaataggcgaagcagctgactctggtcaactgtctatgattttaagttcgtccaggttcttcttgatttcctgaatacggttcaggaatttcttgcgataaatccacaagatcagccccaggccagctccccaaagcaggataaaaaatagaatgatggctatcccatattgccatatctgccaataaataaatgagagtaccgccagtataaggaggaaagcagtggcaatcagacgttcccggatcatccaccgatggatacggttgacacggctgatcacttctatcagaggcatttcgtccactttcgtctgttgtagaaaacgggtggtggtgatgtcccagtatagtgcgggaatccacgatagaatgataatgatatagatcggattcagtctgccgtgcaacaggacttccagcaggaataagaccaataccggcaaagaaatcaggatgagtttgatattcagccgggcaatggcatggatacctttgtctgcatgtcctatcagtttgccaagttcttcctctttgatcagctccttatcttttaagtgctcatccagggcattccatgattttttcagttcttccagttccatatatgattactcctttttcattttttttagtttgtctttgatacggctcagtttggtagccacatttgtcaccgtcagtccggtgatctccgcaatatcttcgtaacttttatcttcaagataaagcaggataattgatttgtcgagttgtcccagttgattgatcatttgataaagttgcctcagcatttcgtggatcgggtcatgttcctctattatccagtccgcttcgcgggtgagggtaacgatttccggtacattcttttctttgcggaaaaagctgatacacgtgttcagggcgatgcggtaaatccatgtggacattttgcattctcttctgaacttgggataggctttccagaggttgagtatcacatcctgatagaggtcattgagcggggcgttaggattggtatataagtaacataccttgtagatcacccgttcatattcgcggatgaccgataagaactcctgttcaatagggttggttgcctctgttgttcgttctctcatgaattaaatgggttacttttctggttagttagtcgtgcgaaaaggagaaaaatcacaagtaaacgaaagttattgcagattggcagccaggaattttcgcatttcctccgtactttttccccgacggcgggcatagtcttcgagctggtcttctcctatctttccgacagagaagtattcggcagccggatgggcaaacatcagtccgcagaccgaagcatgagggtacatggcaccattctcggtcagcgtgattcctatctgtttcatatccagcagttcgtccaacaggaaattgatggattgatcgggcagggacgggtagcctacggcagggcgaatcccttgatatttctcgaccaacagatcgggcattgacagaatttcatctttggcgtatccccacgcttctttgcgtacatattcgtgcatcttttccgtagcagcttctgccagacggtcggaaagagtctggacgagtaaatgcttgtagggatcttgctcgtacaggccttccatatctgcatctatgcaagaagcaaaggcacctattgtatccggaatgccggaagaaagaggacggataaagtcactcagacaaaagaacggacttccgtcccgtttaggcgtctgctggcggagcaaagggaaaactaggaattgatcggtttctttttcaatcaccaggttatctccgtccgagtttgctttgcaaagtttgaagatagttctcacttcataatccttgtcaagtaaatccagcatccggttggcttccttaaacagttgcatagcttcggaagccttgttgcggtcttcttccggaaaagtagtcagccacgaggcacgacagacatcgcaaccgtgaatgttggcgatcgctgcgaaacgaggttggaatccccatgcatggaaaaagtaaatccaattgatgtagggggcgacgttatgtatcttataagataaaatcatatgtttataagtgacgagttgctgtttatctgaatcttaactcctgtccacgataattctcgtcaatggttccgttgttatataacagatgaccgttcacaaatgttttttctaccttccagtggaaagtatgaccttccagcgggctccatttacatttgctcaggatgcagtctgtggtaacagtccactcactgtcggggcgaaccagaaccagatccgcttgatatcctttccggataaatccgcgattgcgtatctcgtacatttgtgcaggggcatgggacatcttctctactaccttttcgatgctgaaagcacccttgtctgccaattcgagcatactgaccaaagagaattgtatggtcggcatgccggacatgacttttaatgcgcccccttctttttcgctcaaggagtgcggagcatggtcggtcgcaatagcgtcgatcagaccgctgttgactgcctcctgcaaagccttccggtcttctgccgttttgatggcaggattacatttgatgcgcgctcctaaggtctgataatcttcttcggtaaaaattagatgagacacacacgcttcggcggtaatacgcttctctgccaaaggtgctttggagaataaactcagttctttggcagtagaaatatgcataatatgcagacgcgcattggtctcgcgtgccaattgtaccgccaaagcggaagaacggtagcaagcctcttccgagcggatgaccggatgaagtgccaaaggtacatcgtcaccatattcttttttatatttatccgtattctctttgatgattccctgatcttcacagtgtgctgcaatcagtaaatccgtacctccaaagatgttgcgcagacttgccatccggtctaccagcatatttcccgtactggaacccataaataacttcactccacatacccggtttttgtccagctgactgaataacggataattattgttagtcgctccgaaataacaggagaagttgacagatgatttttccgccagcaaagccagtttgtcattcagtgcctccaaagttgtggtctgaggatttgtgttcggcatatccataatcgaggtaactcctccggctgccgcggcatggctttccgttgtgatatctgctttatgagtcagccccggatcgcggaaatgtacgtgctcgtcaatagcccccggcaaaagataacagccggatgcgtcaatcgtttcgtcacaaggcatggcagcctcttgtccgtcaactaagatctcagcaatcttctcaccttcaataacaacagatcccggaacttttcttccttcgttgacaattacggcgttttttatcagtatacgtttcatttcttttgcgggaatttatggaaccaactatttatttttaacttgatcactccgaatatggcttctccaaagatactgctgttcatcttggaggttcccaactcacggttaatgaagatgacggggacttctatgatcttgaatccgcatttgtaagcagtgaacttcatctcgatctgaaaagcgtagcctttgaagcgaacatgatccagatcgattgtttccagcacctgacggcggtagcatacaaatccggcagtcgtatcatgcaccggaataccggtaatgaagcggacatacttggaggcaaaataagacatcagcacccgtcccatcggccagttgactacattcacgccgcttacataacgggagccgacagatacgtctcctccttcttttgcacaagccgcatacaaacggggcagatcattcgggttatggctgaaatcggcatccatctcgaagatatattcgtatgcgtgctccaacgcccacttgaatcctgcgatgtaagcagtacccaatcctagcttccctttgcgctcgatcataaagaggcgttcggggaattcctgttgcaaagttttcacaatgcttgcagtgccgtccggagatccgtcttctataaccagtatatggaatactttgtctaagccgaaaacggcacggataatattttctatgttctcccgttcattataggtcgggataataacgatgctatctgataattgcatagaagtcctatttttaagacaaatgtagtgcttttcctttagttataaagggactaaggataatttaacgtgttggcatttgttccccggtgtgaaactattggtttcatgccttgaaacttttagtttcaacctttgaaaccaatagtttcaaggcttgaaacaatcttgaagaagaaaacttcggtgtgactatatcaatcccggttcttttttcgtacttttgcggtgaaattttatagctatgacaataactgagttgcaacaacaatatgccgctcatcctaatacggcagtcatggaacgactgctgaaggatgcgtccgttcaaactattttttgcgggggcttatgtgcttcttccgcttctcttttctcttctgtattggtgaaacaagatgtgtgtccgtttgtctttgtactgggagacctggaagaggcgggctatttttatcatgacctgacacaagtgctgggaacagagaaagtgtttttcttcccgtcttcattccgccgttccatcaagtacggacaaaaggatgcggccaacgagattctgcgtacagaagtactgagccggttgcagaaaggagaagaaggcttgtgcatcgttacttatccggatgcgctggcagagaaagtggtatcccgcaaggagttgagcgataagaccttgaaactgaatgtgggagagaagctggacacgacctttatcacagacgtgctgcatagctacggtttcgaatatgtggattatgtgtacgagccgggacaatatgccgttcggggtagtatcattgacgtcttttcgtttgcttcggaatatccttatcgtattgactttttcggagacgaagtagagagtatccgtacatttgaagtagagtcgcagttgtcccgtgagaggaaagagggagtggctatagtccctgacctggcagtgacgggagatgtgacaacttcttttcttgatttcattcctaaagaaaccgttttggcgatgcgtgactttctttggttgcgcgagcgtatccaggtagtgcacgatgaggctttgacgccacaggctattgccgtgcaggaagccgaagaaaatggaggtattacgctggaaggcaagctgattgacggtagtgaatttacggtacgtgctcttgatttccgccggatggaatttgggaataagccgaccggtacgccggatgcaaagatctctttccatacttccgtacaacctatttttcataagaactttgatctggtggccggttctttcaaggactaccttgaacagggatattcactttatatctgtagcgacagtaccaagcagaccgaccgtatcagagccatttttgaagaccggggagataagattcagtttactcctgtagtacgtacgatacatgaaggctttgtggatcatacgctgcatctgtgtatttttacggatcatcagctgttcgaccgtttccataagtacaacttgaaaagtgacaaggcccgttcgggtaaggtcgctctgtccctcaaagaattgaatcagtttactccgggtgattatgtggttcacacggatcatggtatcggtcgtttctccggtttggtacgcattccgaatggagatactacgcaggaagtgctgaaacttgtctttcagaatgaggatgtcgtgttcgtttccattcattcccttcataaagtttccaaatataaaggtaaggacggagaagctccgcgactgaacaaactgggtaccggtgcctgggagaaactgaaagaccgtacgaaggcgaaaattaaagatattgcccgcgacctcattaaactatattcgcagcgccgtcaggaaaagggtttctcttacagccccgacagcttcttgcagcgtgaactggaagcctcctttatctatgaagatacgcccgaccaaagtaaggcaacgatggaggtgaaggccgatatggaaagcgaccgtccgatggatcgcttggtgtgcggagatgtgggttttggaaagacagaagtagcaatccgtgcagcgttcaaagccgtagccgataataaacaggtggcggtccttgtgccgacgaccgtccttgcctatcagcatttccagacattccgcgaacgtttgaagggtctgccctgccgggtagaatatttgagccgtgcccgtacggcagctcagtccaaagccgtattgaaaggactgaaggaaggagaagtcagtattcttatcggcacccaccgtattttaggaaaagatgttcagtttaaagatttaggcttgctgatcattgatgaagagcagaaattcggagtctctgtgaaggagaagctgcgacagctaaaggtgaatgtggatacattgaccatgactgccacaccgattccacgtacgcttcagttctcgctgatgggagcccgcgacttgagtgtaatctctacgcctccgcctaaccgctatccgattcagacagaagtacataccttcaatgaggaagtgattacggacgcgattaattttgagatgagccgcaacggtcaggttttctttgtcaacaaccggattgcgaaccttccggaactgaaagtgatgatcgaacgtcatattcccgattgccgtgttgccatcgggcatggacagatggaacccacacaactggaacagatcatttttgactttgtcaattatgactatgatgtgcttttggcgactactatcatagagagcggtatcgatattccgaatgccaatacgatcattatcaaccaagcgcagaactttggtctgagtgacctccatcagatgcgtggacgggtaggacgcagtaacaaaaaggctttctgctatctgctggcgcctccgttgagcagtctgacggcagaaggaaaacgacgcttgcaggcgattgagaacttcagtgatttggggagtggcatccatatcgctatgcaggatttggatatacgtggagccggaaacctgcttggagcagaacagagtggcttcattgccgatctggggtacgaaacgtatcagaagatacttgccgaagcagttcatgaactgaggaatgatgagtttgcagaattgtatgcagatgaaataaagggagaaggtcagatcagtggagaagaatttgtagacgaatgtcagatagaaagcgatcttgaacttctgttgccggccacctatgtgacgggcagcagcgagcgtatgttgctttaccgcgaactggacggactgacgctggataaagacgtggatgccttccgtttccgcctggaagaccgcttcggacctgttccgccggaaacgcaggaattgcttcgcatcgttcccctccgtcgcttggcggcgcgactgggagtggagaaggttttcttgaagggcggacgtatgacgctattctttgtttccaatgcggatagtccgttctatcagagtcaggcgtttggcaaaatgatagattacatgatgaaatatacccgtcgctgtgacctgcgtgagcagaacggccgacggagtatgctgataaaggatgtgactaatgtggaaactgccgttagtgtgttgcaggagattgtagcgttgccggtgaaagaactggatgatcattaattgataaataataagagcaatgtttgttttttatattcaaaaatgcttatctttgatctaaagacacagataagaacaagtaagagccatttaaaatctaaaaaataatgaatatgaaaaacatgctgacattgatcgtcctattatcatcgtggttaacggtgtattcgcaagagagttatacggaagctgaactaaaacagaaatgtgattctattgtagaagaagctaatactttgtacagatatgaaacggctgcctggaatttcactgatatgatctttgccaaaccggggttaattgaaacaattcagaatattctgacttaccaccagggcgattctattaaatgtgttgctattgataagcagtcttattgtatctatgaggcaacttttcttaatgaatcagctccatgttcggaagtaactacccgcaggaacttaacagaacaggaaatacttttggctaagataaaagaaaagatacggagtgaacttgctgaccatgaaaaatatccaatttatcgctacgataattatcctctgaattgggatctcataccatttgcagatggatataaattctatgctatttcaggagtatctaaagggcgtgccatacctttcggcaatgattacttatttattgctaataaagaaggagaaattcaatcgtggaagaaatttcattccagacttattccggtggaagctacagaacaaatgccgatgattgcttttcctgttcactcgcatttgaaatatgaaccattcatttcagctactgatatttgtacatttagattatattataataaaaccggtagtactaagttcgctgtatattctacagctctttccatgtatttcatttatgagttagctaccaataccatcactccgacaaaggatataaattttaattcggctcctctttctgaaaaggttgccccatgatttatttatcatgattggaaagagaacaggaaggcattagtaaaagtatattgttctttgtaaatgtgtgaatatatttgcgtctgatgcttttcttctgtcgtctgtgatttttgttttctctttcttatacaagttgctttataaacccgcatcacgtttataataaatagtgaggacgtttattataaacgggtcccaagtttattataaactatattttgccaaattcctcggaatgagaggaattaattaaacaaaatggggtgaaatccttgtggacttcaccccattcttattccttacaatgtactctcatacatgtaaattatatctttatgtctttatatttgtacatttcatgcttttgattccagatttgtttctacaaatatacgaaatttaaaaggcaaagtcaatagggaagccatcttaatggtttcatttgtttctctttccgtataacttgtctatcagatcctgtcggccgatacgtcttaactcattcagaatattctttcgttcttccggcttataccagaagaagaattgtcgttgtgccagtttctcccgttgtgttttggcactgaatacaggttccagtgtatagggatgaaatccgctgtaccatgcttcggtggctacagtcatcggagtaggggtaaagtcctgcacttgctccagatgaaagtccagccgcttggtgataacagccagttccgccatgtcttcttccttgcagccggggtgcgaagagataaagtacggtataagttgctgacgtagattctcttcccggttgatacggtcgaatatttttttgaaagtttcaaactgttcgaatgaaggtttgcgcatgatggataacacccggtcgctggtatgctctggagctactttcaatcgtccgctcacatgattgacaatcaactcgcgtgtgtattcagccgtgctgcgattggtggcggcgtctttactctgatggagcaataagtcgtagcgcactccactgccgataaatgatttttttatgccggggatggcatctaccgctttatatatatccaataacgggcagtggtctgaattaagattcgggcacactttgggatgaatacatgacgggcgtttgcactttttgcatattgcttcatctttacccttcatctgatacatattggcggaagggcctccaaggtcacttaaataccctttgaagtcgggcaactgcatcacctcctttacttcattcaagatagacttcttgctgcggctgacgataaacttcccctgatgtgcggaaatggtgcagaatgcacaaccgccgaagcatccccgatggatgttgacggagaactttatcatatcatatgcgggaatccgctttcctttgtatttaggatggggaaggcgggtatagggcagatcgtacgaatggtcaagctcttcctggctcatcggaggataaggaggattgacaacgaccactttattatctacctcttgtgtgatacgggaagccgcatatttattggattcttcttcgatgtgccggaaattgctggcctgtttctttttgtcagccagacactcttcatgtgagtaaagctgaatatcgtctgcggcaggagtccactctgtcgcacggcagagataggctgtctgagggatagttcccgctattttcttgagttcaccggctgtcaatgaagcatcctccgcaggaagcagttccttcattttccgggttagttctacaatcggcttttctcccataccatagatcagcaagtctgcgccactatcgcataagatacttttctgaactttatcctgccagtaatcataatgactcagacggcgcaaactcgcttcaatacttcctaatataacaggaacgtccggatagagtctttttagaatctgactgtatacgatggaaggatactccggacgcatatccggacggccgtccggagtgtacgcatcctcactgcgcagacgcttgttggcagtgtatttgttaaccatcgagtccatacttccggcagagatgccgaagaataatcggggacgacccagctttctgaagtcacgcaggtcatcacgccagttgggctgggggatgatcgcaactttcaaaccttccgcttcgaggatacgtccgatgacggcagcgccaaatgagggatggtctacgtaagcatcaccgctgaaaagaatgacatccagttcatcccatccgcggagttccacttctttcttggtggtaggtaaccaatcggtcaatcgatattctttcatgccgcaaagatacggataataaaaaacatcccaatgatttttttattcattgggatgtttaacttcaatcattaagatgtttttttaaaacttctcattgattgtaaattgcaatgtcatttgctctccgtcatagatttcacgaaaaccgatgctttgctcggaaagatattcctttaagtcttggaaagcatctgcatgattcatgataatttcgagcgtttcaccgaaaggagcctcgcatatagctttgattgcaggaatcaaaggactgtaagctgttgttccgcaggtatctaccgtaatcattattcttcctcctcttccgcatcctgagtggaaagccaggtgagatagagcttgatgagttgttgcaggccgaatgctttcatgttattgtgataaataacatctatgcaaagatccagcaattctttactgtcctcttcctgactggcaatcagggaacgaatatttagtttcagtttatccagtacgggttcgtctacaattccggtactatcgatgagatggcggaataaggcatatttctcgattgttttcagattttcgctggacacctctatgctgcgtgtaccgctggggtttgcttgtatagtatacatcgttttttagttttaagggttattactaggagcaaagatagaatttaaaatgaaaaacgaattaaaaaagcccggatatttttatccgggctttcagaaaataaatcttatatccgtgagtactttatttctgagtaaagaaacctagtatcccggccataatgctggcgcgatctgtttccgactgaatgctttcgaaaggaaagccgagtacgaaggtgcgatagtctgctcctttgtaagcaatgcctgccgactgattgccacgtgcataagtaaatactggaaatgcgggagctaccggaacgatgcagtccggtgccgtaacagcataactggtctcattgggcaggcgggggatcgtgatgctgcgtcctaatccattgatttgaccggaacttttgtctgtcagactgttctgataaccgtatttcaaaactttctctgtaaactcccggttcccttgtgttccgctcatgtcacttcccacatacgcaccgctgacgaacaaatgacctcctgactggcaatagcttgtaatcagtctttgcatcggtgaagagaatgttttgtaatatgctttggctatcgggtcttccttttcaagtccgagtatatagtctacgatcgggtaatcttctaaagtgacgattccattctctaccgcttcgtcgctgcacgagacaaagctgtatttccctgctgcctgaatggctttcccatgaatgaaaggataatcaaacgtatttcctgctatctccatgccttccagctctctgccgctatgtcccaggctgccttctccttcttttccagcttgtgaacggttgaatccgctttgtgccccgcaaaaagagatattggataaataaggcactcccggatcctgttccagatcaaatccggctttgtccggtgtgttaatgacagccggaccgctgattctgtcgaatccattgataatcaagattctctctcgttcacgttttgccttataagccgaaaggatttcagaaggaaaactttctcctccccggtttacggctgtcactttgaacgaatagacaagtcccggttctactttgacactgtaatagggtttgctgaccagagttccgttgtcgaatcctccgtatccgatgcgtgtatataccatatattcccgtggacgggctgtcggttccagcggatcgtcttcccctttccaggtaagttccagtgtgtttttcttttttccgaaatggatagcgaagttgctgaccggaagaggttgcactacatagtctttgccatgctgactgtttataaattgcaggatacctttgtagatagcacgtcctacggtaaacttgaaattcggattatgaccaagctgcatatctgcaaagttctgatgagagagcaattcgataatcgtggaaggagtagcaggaagtcgtgtttcactgtaattccggttccacatactgcggcgtgtccatggtagattgtagttcgtacgaatatctttctgaatttgagtcagcaggatatccgcaagatcacgtgaagcatatctgtccattcccgaatttagtttgccattattgaaatcggtggtatagatgccgagcgaaccgatgatttcatcgtctttactgcatccagcgtcactatgaagtgccatagtcatttccagaggtacacctaaacccgtttgtcccggattatagacagagcctcccgacagatagttgattgtattggaacgtgtattgatatcgtctgtataatcgttttctcctttacgcccggcatatacatcgtatggcataccggcccactgggatgaatatcgtgctccttccagataacgggggagtccgcttatttttcctccgcgtgagatattacccattcctcctccgaagcgtacggcatctgcacacactacgccatgctcgctactttcattactcagtacaaccatgccgtagtcattatttcctttgtcaaactcaaaagttccgagatatacccaagtaccgccgcctattttttgattgaccttaaattccgtgacacccccattatgaaagacgaggtatttggcatcgctcacgctattgggtagtgtctgatatgaaacatagaccgcatattttccggttgccggcagggtaggtacccattcggcaaaagcctgatccttattcttcttttttttcttttctgtttgaatataccggctggtaccgtcagtgaaagggttttccccatctttgtaaatggcttttttctgggcgaatcctttcacggaagtagtcgtccagcgtgctttcttactgcctacttccaaataaagggaagcattcggagtatcgttgtcaacaatgatttcattcttttgtgtgtcccgttcgcgaggagtatacacaatggcaccggcattttccaacatcggaatgacgtatggaagaatgaaggattgagtgaacatatcttctgtggtgcagaataatcgggggcgctgccatccccattcgcctttgtcattcttataataattaccgtgactttgccagagggcaatatgccggtcctgcaatcctcgggatatctcattggggcgggaagtgtttttcacccatggagcacctttgtattcggtgttcagcgccattcgttctttatcctttttcttgcttctgtacaagttgggaactaattcttcaatgggctttccatctgcataaatggtgatctgataatagtttaccggaccggggagcagttctttcatctgattgtagatggtttctaccgtttccggcagaaagggctggtaggcgaagctttccgaagcataaatctgaatggttctgcggtcataatcaatatcgaaactgttcagtttcggtgtactgattttagctgtcgctgtgtatttggcaaagtaatccgttaaccgctcttttatatttctctcaatgtcctgagcgaagagaagactggtgcccattgtcaggcacagaagaaagactattatttttttcatcgttccactctttaggttgcatcctatgattatctatgtccgccactttccccttgatggcatttccccttttggaaggagaatacgaaatgaatctcgcgttcatgtaagtccattgtattctgtggcaaaatctcctgcaaaaataaacaaaaaaagagtgggaagtatcgaactgcccactcttctttgattgttttatattctattaattaagaattttctttcttatagaggaatgtattctacaaatgcctccattgcctcatacgatgccagtcctaactgatcatacaacgttgctgtgccacggttacggtcttcgctacgttgccagaacagacgttcgtcattacctaagaacggagcgctttccatctgcgactgatgcttcaggatagaattacgttttgcacgaagctcttccggactgataggcacagccatttcgatgttctcaatttcccattcagcccacgcaccacgatacatccagatacgacagtctttcaaccatttggctccttcttctttttcaagatcgacagcagcgaatacggcatccgtacatacacggtgtgtaccgtgtgggtcagccaaatcaccggctacgaaaatctgatgaggctttatttcacgaagcaggttacgtacgatctctacgtcagcctcgctaatcggatttttctgaatcttaccggtttcatagaacggcaagtcaaggaaatgtacccgatctagcggaatattattgtatgaagaagcggtacgggcttcaccacgacgaatcaaacctttgatagtcagaatgtcacggctgtccatatcaccgtctttcttttctttcaggaatttgcgtatttctgcatatttctcgctgattaccaagtcttcgctgttattgaaaatctgattgaatccgttaatgaaatgcatgaaacgaaccacttcctcatcacctacggcaatgttaccggaagtttcgtaagctacgtgtacctcatgcttctgttctaccaggcggcggagggttccacccatggagataacgtcgtcatccggatgcggagagaagataaccacacgtttcggatacggtttggcacgttccggacgataagtatcgtcagcattaggtttgccacccggccatccggtgatggtatgctgcaagtcgttgaaaatcttgatatttacattgtaagcagaaccaaacaatgccagaagttcgctcagaccgttttcgttgtagtccttgttggtcagcttcagaatcggtttgcctgtcaactggcacagccatacgatagcgctgcggatcagtttatcattccactcgcaggatgttaccagccacggacgttgaatgcgtgttaagttcatggaagccgaaaggtcgatcgctacatgagcattgttgtgagtttgcagataagatgcaggaattgtgtcactaatcggaccttccacacattctttgatcattgctgccttattttccccccatgccagcaaatatacctttttagcgccaagaatggtagatactcccattgtgatagaactgatcggagtattttctattgttccgaaaatcttggatgcttcgttgcgcgatgcattgtccaataagatcagacgtgtggtagagttcagacgtgaacccggttcgttgaatgcgatattacctacacgaccgatacccagcagggcaatgtcaatacctccgaaactttcgatgcgctgttcgtacagacggcaatattcaaagatggtatctttggcgatggttccatcgggagtgaatatattctgtttgtcaatatcgacatgatccagcaacatttcttttaaagcattgaagttgctgttgatagcatcggctgtcaacggatagtattcatacatattaaatacgatcacgttacggaagctcagtccttcttccttatgcatgcggatcagttccgaatagacatggctgggtgagttacctccggggagtgctagtacgcaaaagcgtcctgctttctgtttttcgcggatggtttgtgctatttcgcaagcaatgtagttagccccttcttctacagactcataaatgtctgtaggtattttctcgagtcttgtcaagactgatttttcaaatgcattctccggtctgtagtatctgggggagaccctgtggagagtgatttgagaactaagatttgttttcataaagttgttaattaagttatgtaagattagagtccttacgactgtattttcacgacaaagatacaaaagaagtctatataattaactactaacttctaggtattgttgcaccttcaaatcgtttttaacatttgtttcatcacgaatggcggagttggaattcgtctgcatctttccataccggaaacttttctctgaactgatgaagtgcggtcagatgaagcgtagcggttgctatgccctccgtttcgtcgggcacggaagccgcttcttctccgagcgctgaatagattttgcttcctccgttgtatttcagccgatatccgtctatacctactctgttaaccccgcacacgtaacactgattttcaagggcacgggcacgaagcagcgtatcccatgccaggcggcgggggataggccagtttgctacatatattaataggtcatattgattggctacgttccggctccacaccggaaaacgaagatcgtagcatacaagcagacagatattccagccacggtaagggataatcagacgttcatcgcctgccgagaaatgttctgcctcacgtcccatgcgaaacagatggcgtttatcataatagaattcttctccttccggtgtcagaaagaaggcgcgattgtaatatcgtccgttgtctacagtgatataactcccgcagatggccacttgaaacaaagaagcccattgtttcagtgttgtaatcgtttcgccggaatttgcttccgccagcatatcactttgcatgctgaatcctgtagaaaacatctccggtaaaacaacaatctccgttgttccacagagactttgcagcttctcgtggagcaaacggagattttcttgtttgttttcccaaacgatatcggtttgtactatggaaatacgaatcgaatccatgatgcctgttttaagtaatagggaataagtaataggtaataagtaataggtaatataccatgcggagcagcatttcagcagctacgattaatacttaatacctattacttattactttattcttaaagttctccaagtgcaaaattctcaggatgttttcctttgaaatccttgaagtacagtttgatttcccgcatatctttattaagatctcccgtcggcataattgctttagtggacgttatggtctttgtactgtagtcaataccgatcagaacgataggcacttgagccttgagagcgatgtaataaaacccttttttccagttcgggttcgccttgcgggttccttcgggtgtgatagccagatgaaactttttgcattcagcaaaatgatgaaccatctggtcgaccaacgaagttttccgactacggtctacgggaattccgcctacagctttaaaaataattcctaacggaaaaaagaaccagtcttttttcatcatgaaacttgttttacggcctaatgctccataaaacagttttccaataaataaatcaaggttcgttgtgtgtggtgcggcacatatcacgcatttatcataattaggtaccgtaacgtttgtcttccaccctaacaggcggtaatagataaagctataaattgctttcttcattctgatctttaattcaatttcccgatggcctcaataatctcgttaacttttgcattgaaatctactcggaatttcttataaaagcctttcacattgcccggctctgtatggctgatgcggctgacaaattcatcctgcattcttaaaacttcagccatcagttcatcagctttagccttgtcagtaccagggataaacatactattgattaagcactcggtgaataattctcctgcgatatagtttacgttctttttaagttctcttctacttgccataatatttacatttaatggtgaataataaaaattacttggggtaaagatagggactttctttgattctagcgaataaatggattgaattttttctttttactatttgctctctaagtgtatcctgcttggatatacaattgattaatcaaccggattttgaaatattgaattaaaattgaacagatttgaatgaaatttagtcaaacggggaattgcctcgacaaggatgaggtattttatttattacgcccgacacccctttggtgggggaacgccctgcggcaaggggggcgaccacgcccaccgactaagcgcctcccccaaagggggacgggagggggtagaacaaaaatacctctttataaatttatagataacagcgtttctattcctcttcctgcgtttatttatggatagaagaacacccaatcagaaagaaaacagtcagctatatgccggaaattgcgaaaaacatctccaagaaaacaacaagagttttctaaaaaacgtcagacattttttgaaaaactcctgatatattccgcaagccctgcagacagtctctaacagctgaaaacgaagaaagcccgatgaacttcttctgttcatcaggctttcttttcaaatggttactgatacgtagcggatgaccgctttaaactgtcgggtctggtgcttcttcgtctccgcccccggggttgtcgatatcccctccaccgggcttttcggtattcccgccttcggcagtcgcgccaaccttagagaaagcatacattgctaccgcttccttgatttctgcagaaggtacgtagatcacgcgggctttcttcacgttacttgccgtaaacttatccacattttcgctaccgatacccgatacggaaggacggaatgagccaaggtcgcctaagcgaataggagaaccgttggcaaggttacgtttgataactgtcatcaatgcgtccagcaccgctttcacgtctgagccagttacggtacaacggtcagcgatctggtcgatgatttgtctctgtgtcatttccggagcaagaactacctgagcgtagtattttccggctgcttttttgtcctgcggattcttacgcaaggatgcttttacttgaattgccatgtttattagtgtttagtgattaatgattcattctgcgggcaaagttatatatacgcgcgggcggctgcgggcgtgcattcttatctatgatgatatgtgatgcatgatgcgtttatgtacatgaaaaaagggctgcggggtatgtccgcagccctcaaaacaggggttttcccattgccgggtattacaggagttagtccttcttctcgttatcgttgaccgggctgtccgctccggtcagccaaacgaaaattttaccgatcactttcaatactcgcaacgtgtttctccaaaatggtttcatattgacctcctttttaattgttcccggcaaaggtagggtgaatggataatggataatgagcaatgaataattggctacgctttcatgcgcttatataccgcatggtacattatccattctccattttccattttccattaaataaccgtattcggtccggacattgaagcagggacattctttgatgtactcgcatggttctatgattccgttatggttgagatcgggactcagatcacgatggccgcagacctttgctcccggataggtgagtaacagaaagcgcaggagcgtttcaaggctttgtttttgtgcggtggtacgtgtgtcggttgctttgcctgatgcgttaagacctccttcgtaagcgattcctattgattcgctgttgtggcctttgacgtgtgcgccgatcttggtaatgtcgcgcatgtggtgtatccggccgtcttttgtgatgtaataatgatagccgcattcggtgaagccttgacgcttgtgcatggcgtcgagggagggcggggtgagatcactggtgcagcgggaggcggtgcaatgcaccacgatcagggaaatgtttctttgtttgatcattgttttgtgggtgattatgtgagtaatttctagttgtgtatttctcatctacccccctcccgtccccctttgggggaggcgctcagtcggtgggcgttcccccaccaaaggggtgtcgggctgtagccgtgggagtggctgcgctatggggtcagaagggtgaaccgaaagtggtcgtaataaggtctctctgtttaggggtgagaatacggttgctgaggtggtagttggtttcttccagtgatcccaatagttctacgtcatcctttatccactgtttaaggcggatactcgcagaggcaggggctatattggggaagtaaagtacggccagctctttaaagccataacttcggttactcaggttggcttgatagttgttttgtgagtgtacgtttgtatacatggttcggaatattggtttacagtcgtaaaggtagggcttttaatgtgtagttgtcatccggaaactgagtagatatagttatatatgcttgttaaaggctggaagttgtgacaatggcgcaaatgtcacaactttcggcggtcggcttcgccgtccgctccgcggagcggggcggcacgccccgccgggaaacttcggtatgccgcagggtggaaacagtcagccgggcacgccgacaggcgcagtccgaaggaggagcggaaagacggaagtaacttcggggcggtggtcggggacagccgccgtcccatgtgagaagctacggggcggctgtgtggaggcggtaatgttccgcaaggggtaactttgagcccggtaccgagaaacgggaaactacccaaacagcgggaatatccataatgcgctgttatgtttaataaaagggcggaatccggaacggctccgcaacttattaaacataattgcctattatggattttccgcgcaaaagctgcagcaggacagaaacaccggaagcaccccgcgcacgcagcatcacgaccgcacgcgcccggaggacggcgaagggcgctgacttccgtagaacaaatgcgtttgcgataaacacgggaaccccgtaccgcatggctgcacttcggaccgactgcctgtttcctgtcgttcagacgcaggaaggtagcggattgagccttgtcccggcaacaagtgccgggcagagcgaaaccgcaccgggcattgaaaacgactgagtacacaccgcatgggctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctacacctgatcatcccgatatctcactcgttatgatagcagatctttcgccggcagctgttcctggagaaaccatttgctatcacatttattcagatcgagatcttcttccggagaaatcagctatcacctttccgactgacatcggcaggatgctctacttccggtcatcctccatcgtctgctgcaatctttcgaatgctttgaggaaatctcccacagcgattttctgatcctggtacttgcgttgcaattctcccttctcccgtgcctcctgcttgtagtgggcacagaatcgggggtattccttcacgatatactttatcgcttcactgccgcttttctttccggtgatggatttgagcacttccatctgtgcggcctcttcggctgtcagccgtagcgtgaggatgctcactttttcgctcataattgcccgcctccttcacttgccgattcattaacagccgctttgccggcccgattttcattattcagtttcgccgccctgtcgaatgcttcggcatacgtccggcacttgattccgtaacgctcgatcttgacgcctgcggctgtcacttcatgggccacgcaccatcctatacgcattttgcggggatagtacagcgtttcttttgttgtattttcgttcattgtttttcgttcttttgagtgatcaatcaggaggcttctttcgctttaccgcccgggcttcctccggccactagtcccattgcatcccgcagtcgcttcaacaggaatagacgcggcattttgagacgtttgtttccgtgcatttcggcaagaatagaccagacaggatttccgatttctccatgccgtgagagctgcagtacctcctccagctctctttgcgacagattgtagggacgcagcgtgtttatcagcccctgcggattgcgctgtttctcttcctccgccttcacatccgccttcacatccgcctgtgacggttgatgcctggcgatatccggtttggagctacggtcctcacccaatacggtagaagaaagtaaaactctcgcttcctcctccgtaagcgctccggaaggctgcgggggagtagaggaggattttctttgtttttcttttattttcttttctttgtctgttttttccggaatgtttccggaactttccggagtattctggaaagtttccggagtactccggaatttttgttcggccaatgttgcctgattcggtgtatcgtgttccgccgccccggccccgccttcgaagagtggcatcgctacaggctccctcatcggctgttccggttctacaagcaggatttcgagcggtatgtatgatttcttcttgctgatcttgcagatatcgagatatcggctttgaatggcacgtgaggtcagtatgcattgcgtcttccacatcacggggtcgaacaggcatacttcggcacagtaaccgatgatctccttcacccgtgcttcgttcatgtcccaatagtcggcacagtcaaagagctggtcttccgtccagcggatatatgcgccttccacccggtagatttcgttcagcgcgtattggtagacagcgtatccgtcgcatccgtatttctttttcagacgctttatcttaatgtcctgaaagcggtctgtctccgctttgtaataggagaatccattcttactcataatcttttgctataattggatgccagataattcatgatttcttctttgttgtaaaggaacgttccgcccagcttgtagaagggaatagcctgcgctgcgcgcaggtttctcaatgttgaattgctgacgttgagtagcttacacacatctgcagagcgaataaatgtcacgtcttcggagacattgtcgagtatgacgggggtaacgggcttgtacttcgcttctttccgttcctgttcattggctgtactttcggttttcatgattttcatgttattgttctttgttttcattgttctacttctttatagggattaatattcattttttatgtatttgaaagctattcggtcgagatcattcagttggttgcttttcagggcgtagatcgtttttataatccatcctttgaggacaatgctgcggtgtccttcgacgttgctatagtgctgcagtgcgtcattgagcgctttccccatcttctgttcggagatgaggttccgttcgtatgctatcatgctgtcgattgctttttgttcgagggcttgctggatgagggttgcggttgttttcattcgtttgctgctttattgctgggtgattcttgtgattctttccgggcgtacatttctttgagggctgccatgtcgtccataaccttcgtatccaaaatcttagcgtagatttgcgtcgtcttgatactggtatgtccaagcattttcgatacggtttcaatcggtatgccatgagacaaggtaatagtagtggcgaacgtatgccgggccatatggaatatacaaggcgaagcaagcaataatgaacaggtaaagattaaacgtaagtcgtttgaaatgagctgtatttctgtattctgcaaaatgtggaaaatgcaaacgacaacagaatattgaggttgttcagttaccaaaccgttagccgggcggttaccgaaacaaaaacaggtaacggtaagcgatgaaaagaaatcctcaccgttttatttgcactcatacacagtattttgcatatcaaggaacgcttatatggcaagtatttttgcactaaaaagtataagcgtatgaaagtagaaaaattcaaggtattgctctacctcaaaaagagcggaccggacaagtcgggaaaagctcccatcatgggacgcattacggtaaacaggacaatggcacagttcggatgcaaactgtcctgcactcccgaattatggaatccacgtgaaagccgtctgaacggcaaaagcaaggaagcggttgagatcaatgctaagattgaaaagttactgttagcggtaaacaatgcctttgacaaccttgtgaatcgcaaggttgattttgatgctaccgatgtgaaaaacctttttcagggcagcatggaaacgcagatgacgctcatgcgaatgacggatgttgtctgcgatgacctcaaagcccgtatcggcatagacagggcaaaagggacttatcccggttatcactatatgcgcctgacaatcggggagttcatcgagaacaagtacaaggtgaaagatttggcatttggacaactgacagagcagttcatccacgactatcagtcttttgccacggaagagaaaggctatgcgattgatactgtccgccatcatcttgccatcctgaagaagatatgccgtctggcgtataaggatggatatgccgacagaatccacttccagcattttaccttaccaaagaagacggaaacgacaccacgggcattgagtcgtgaatcgtttgagaaaatccgtgatgtggaaatacccgcttaccgcaaatcccatatactggcaagggatatgtttctcttcgggtgctacaccggggtctgttatgcggatgttgtctcgattacccacgagaacctatatacggatgaggacggtgctttgtggttgaagtatcgaagaaagaaaaacgaacttcgtgcctgtgtgaaactgttaccggaagcgattgcgctgattgaaaaatatcatagtgaggatagggacaccctgttccctttgctgcattggtcaaatctcagacgacacatgaaagcgttggcggcactggcaggcatcaaggatgatttgtgttatcatcaggcgaggcacagcttcgcctcgctgattacgcttgaagcaggtgtgccgatagaaaccatcagtaggatgctgggacattccgacatttccacaacacaggtctatgcccgtgtcagcccgaagaaacttttcgaggacatggacaagttcatagaagccaccaaagattttcaattagttctttaatcctttaatacagaaaactatatgcgaagcacattttcacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaaacgagattaaatccgtaagggaaaataaccgcttacgagaatatttacgactgacagaggaagcctacaatgagatactgaaatcgcaaggtgtggtcagtgccgagattttgaagaaccacatatccttgaacaacatccatccgaccactcttctacagatgggagaatgggaacgtgagcggttgaagaagcattccgaagaaatagactcgacttcttcctgtcgaagttcaatgtattatcagaagtacctgacggattttcttacgtccatcggtaaaaaggacattccccttgaagaagtgacggaggatttcggcaagtcctacaaagcccacttgaagaaatgcaagaacttcggggcttcccagaccaaccattgcctgcgttggctgaaccgactgttgtaccttgcagtagacaaggagattctccgtgtaaatccctgtgaggacttggaatatgagacaaagccggaagcaaggcacaggtacatcagccgtgaggagttcaagaagatactttccacaccgatgtatgacaagcgtatggaactggcaagacgggctttcatattttccaccctgacgggactggcgtatgtggacatcaaacttcttcatccccaccatatcggaacaaacgctgatggcagacggtacatccgcatcaaccgaaaaaagacaaaggtggaggcattcatacccttacatcccatagcggagcggatattgtcgctgtataacacgaccgatgacgagaagcccgtgtttcctcttcccaaccgtgatgccctatggtttgaggttcacgagttgggaataaccatagggaaagaggaaaacttgacctatcaccaaagtcggcacagtttcggaacatttttgatttcggcagatatacccattgagagtatcgccaagatgatgggacactccaatatcaggacgacacagggatatgcacggataaccgatgataaaatttccaaagatatggacaaactgatggagcgaagaaaggaaatatcgtctggcgaaaagaagaaatagcaaataatcatcataaaataaagggattatgagcagaggcataataacaatcagtgaaacggatgcagtcactatgccaaccgcacccgtatggatgatgcaatttgagattgccgacctgttcggggtgttctcatgcaatgtccgcaaggcaatacgggcaatctataagaacaatgaactgaatgaagccgatacgatgcgatatatcaggcaaccggatggtatcagttatgacgtttacaaccttgaactggttatagccattgcattcaggatatgcagtaaagaaagtgctttgttcagacggtttataataaatgaaatcagcactaccaaaagagaaacacctgttacgttgtttgtttcctgtggcaggagtaataaccgatggtatagttgaggttcatcccgtcagtaacttgtttccgttgccacacgtttgaaaggcatccgacaacgaaaaacaagcaactgatgggtaattataagagcagaaaaggaacggcttacggatgaagtgtcaatactgcgcttcgtctgtaagccgttccttttttctttttgtcgaaagtctattgctgccgcaatacagggcatacggcaaactgcactcctttaagaaaaatcaagttatcctttgtcggtaggcggagcggtagccgtcattcagcatccgttcgatgtcggattcacggtagaggattttaccgcccaactggatataggcgatacgcccttcattgcggtagtcctgaagtgtccggcggctcaccttcagccgtgccgacacctccttgtcagtgaagaaacgctcaccgcccaatgtcgggcggtaattggcggtcaggtgctctacattatcaagcagtcggtcaagactgcccataaagtggattatccacttgttgtccttgttaatcaactcattcatattactctggatttagtgggtgttgtcattatatttaattcatatagtctttcctttgaacttcgcttcctttcttctatcctccacaacggagacaatgagttccacgtcttcgggacggtaatacgtcttgtggtttatctgtgaataagccagcgtgccgttatcccgaagcgtctgtaacgtgcgagggctgatgttgagcatacggcacacgtcctgattatccatccattcgctcattttcttttccccgtgccgatggcagatggcatccatacggctgacgaaacggtcgaacttggcgaccattgcctcaaaggtctttctttcgattgatacaatttccatattgcctttcttttaattgttactgtttcttttgccacaaagaaatacattatccgctgtcatgcaatggattttcaaaaagtggcagcgtgttgcgccgatacggtagtcattgtccggggtactgcttgccggttatctgtgagcaagccggtggaatacgatttccgttcagcctttaattccctttttttataaagaagccacagccaaaataagggcttaatttaaaattgtccccaatcgtacctttgtactttcagctattcatatccggcaaatcggtgaagtccgcaccgatttgtcagtccccataaagcaaaaccgtacaaaaatgactaagaaaatccaagtgcttgactgactgtattaaagcaccttacttcgctcccgataatcggtcgaggtatagaccaagaccacattcaataacttaatcaatttgtttttacaatgaaaaaagaaccaaacattacagagcgtcaagctcgtgaaatcgtggaaaaaatggggcgcagggaaccctacacctccaagtcgatagacgacttctacaggagtatcggtctggaaccggaggagccggaacagcccggcaagaccgtcacggaagaagcagaaattcatatggcagaagaaccgtcaggagtggcgagcggagaagcggtaatgccgcagaagcgtatcagtggcaaacagcgcaggctgtctttagaagagtaccgcaccacctatctcaaagttcccaaaattatcaaccgcaagcccgtgttcgtcagtgagacggtgcgtgacgagttggacagggttgtccgctacctcggagggaagggcatgagcgcatccggacttatagagaaccttgtccgcctgcacctcgaggcctaccggaatgacatcgagcaatggcgcaaactctgacgggattacggtggaacaggttgagccgttggatgtactccatcggttcgaccgatacacaaagtgagttattacactcggaaatcaatccgacaggcggaggatttttgtgtcctcaaagacacagcaaggtatgttttcagttactcggatgttccggagtaactgaaaacccttgcaccgccgtgggcagaattatcctccgaagtcggataatttcaatctttctttatcagagattagacagtgaacaaaccataaaattgaaagaataagaagcatgaaaaagaagagtaaatacgggagaagtcccaagctgaatccgaagacgcactgcgtgatggtgcgcttcgatgatgaggaatggaacaagttcctcacgatgtacgaggaatcacaggtatatgcgaaagccgtctttctcaaggcgcacttcttcgggcagaagttcaaggtgttaaaggtggacaaggcgatgctggaatactacaccaagttgtcggacttccacgcccagttccgtgccatcggcacgaactataatcaggtagtcaaagagctgcgatgtcatttttcggagaagaaggcaatggctctgctctacaagttggaaagttgtaccattgaacttgtgaagttgagccgggagattgtggagctttcaagggagatggagaagtgttatcaatccaaatccgactgatatggcatcgataaaggtcaagtttcgcccatccaccgtaaacggcagggagggtacactctactatcaggtcatccacaaccgtgtggtcagacagataaacacagagtataaacttttcgtttcggaatgggactgccattctgaaacggttgtcttacatcatatatcgacaggacaagagaggaacaattatctgctttcaatcggttcacgtatcaagtgggacaaggagagattgaacaaaatcatacacacgttatcccagtccggcacatttgtaacggacgatataatcatgcgctttcatgacaacaggcaagaactgtcgtttaacgcttacatcagccagcagatagcgagactgaaacgcttggggaagatacgcacttctgaaacttatacagctgcactcagaagttttagcggttttatgaatgacccagaggccttgtttgaccaatttaatgcggatttgttggcagagtacgaggcttatttgaaaggcaggggaaatacgctcaacaccatatccttctatatgcgtattctgaaagcggtctataaccgtgcggtggaagatggattgaccgaacaacgacatccgttcaagtccgtctatacgggagtggagaaaaccataaagcgagccttgtcactcaatgatattagacgcatcaaagggcttgacttgtcattgatgcccaatcttgactatacccgtgacatgttcctgttcagtttctatacaagaggaatgtcgtttatcgacatggcttatctgagaaagaaggacttgcagaatggcactctttcctatcgcagacggaagacgggacaacggttgttcatcaaatgggaaaggtgtatgcaagagattcttgacaaatatttggtaaacgaaacggaatacctcttgcccatcattacaaaacgggacgatgattatcggaagcaatacgccaacgaacttcaccgagtaaaccatctgttgaagaaaatcggaaagcaactggatttgccaatacccttaacgatgtatgttggtcggcattcgtgggcaagtatcgccaagagccgtaatgtgcctatctctgtcattagtgagggcatggggcatgattcagagaacactacgcagatttatcttgcatcgctggatactactgtggtggataaagccaataagaaaatactggatttactgtgaagccgtggatgttttgcgaatctgtccaacgcttgccaagagacggatattataatgcaaagttacgcaaaataatgatttttaggtcataaaacgctgaaaatcttgtctattgccgtgcttttgttttgtaaaagataccagatgttttataaaagttagctatgcaaaagtaaaatacaactctatatcagcaggataagaaggcttatccgtctcttggcaagagaagtattatttctccttattcccataagagacgggcgtaaacttgatataaaatgcctgtagaagttgatatattggaagatagcatattccagctttcaccggaattgctgaacaccttgctcaaagaccatactacgagcaaggctgatatgcaacgcaatatcttctgggctacttcagattatgaacatattggcaaagaataccaatacaattctcctattctcccccacctcataataggagataacggacatatcatcatgcctcgtgtcctcaaaagtcgtgatacccagtcaatccgttctcgtgatatggctgaggttttcactccatcatggatatgcaatgcgcagaacaacttgattgatgaagcatggttcggacgaaatgatgttttcaatactgaatatgcaaacgaacagggacaccataaatggaaatcaacggaaggcagcatcatatttccggagggtaaaacttggaaggactatgtacgcgatatccgattggaaatcacttgtggagaagccccatacctgataagccgctatgataccacgacaggcgaaactatccctttggaacagcgtatcggtttacttgaccgcaaactaagggtggtaagcgagaacacatccacttcgggtgaatggcttgagtgggcacaagaagcctataaaagtatctacggttacgaatggcagggggacaatctactcattgcccgagaatctttgctcgtctcctttgtggagtattaccaacagaaatttggcaaacgccccttgttgaaatccatcaactacatcgcttatatcatttcgtggaacgtatggcagatggacggattgaaaggtgtcattccaaacagttgcggagaacgcaaggaggttgtagccgacctgttcgggactaccgaagtggttacccaatgtgaaggatgtctgaaagacgacatccgcaggcacaatggtgtctattgccaaatcaaggactggcatgctaccgacaaggcaacaggcaaaaaggggaaacgaatacgatttatagaccttataaaatagtgcagtatgaaattcacatcttcactaaaactaaaactgatatatgtgttccgcatcaatgatgctgcacataggggatgcctgaaagtgggcgaggccacttgtgacaatgacaatgttttcggtcttgctccgaacagcaaggctctcaacgagtccgcgaagaaacgcatcaaccaatatacgcagacggctggtatcgcatacgacctcttatatacggaactgacgatatacaacagcaaaaagagcttgtgctctttcaacgacaaggaagtgcatagcgttctggaacgttccggcattaggaaaaagatattcgataccgagaacaaagccaacgagtggtttattaccgaccttgagactgtcaaacgggcaataattgccgtaaaggagggacgggaatcgctctcttccgccgaagtttcacacgcccagactccgattgtattccgcccggaacaacgggaagccattgaaaagaccaagaaacaattcaagaagggtaatcagatgctttggaatgccaagatgcgttttggcaagacgttgtcggcattgcaagtggtgaagggtatggatttcagtcgcactttgattcttacacatcgccctgtggtggatagcggctggttcgaggatttcggcaagatattctatgactgtccctgttttgcatacggctcaaagaacaatggtgacagccatgcttcacttgaagcgagagcgaagcagggtaaatgccaatatgtctatttcgcttccatgcaggatttgcgcggttctgaacttgtgggcggcaacttcgacaagaacaatgaggtgtttgccaccgcttgggattgcatcatcgtggacgaggcgcacgaagggacacagacggaactcggcaaggctgtcatgcaggaactgacaaaagcaaataccaagatattgcgactttccggcactccgttcaacctgttggatgacttcaaggaggacgagatttacacttgggactatgtgatggagcaacgggcaaaggcttcatgggatttgacccatttcggtgatccgaatccatacgcctccctgcccacgatgaacatctatacatgcgacctcggacggttgctccatgagttcgtggatgaagatgtggcttttaacttccgtgagtttttccgggtaaatgaagccggaaactttatccatgaaaaagatgtgaaggcatttttgaatcttatctccaaggaggacaaggacagttgctatccgtttgccaacgaggaatatcgcaacatcttccgtcatacactatggatgttgccgggtgtgaaggaggctcgtgccatgagtgctttactacaatcacatcctgtattccagcatttcaaggtggtgaatgtggcaggagacggtgacgaggacgaagagagtaaggatgcgcttgctgcggtggaagaagccatcggcaaagaccctgatgccactcgtaccattaccttgtcttgcggacgattgaccacgggtgtcagtgtcaaggcgtggacgggcgtattcatgttgtccggctcttataataccgctgcatcaagttatatgcagaccatcttccgtgtgcagacgcctgccaccatcaacggacgcgtcaaggaacagtgttatgtgtttgattttgcgccggacagaacactgaaagttattgccgagacagcgaagatttcctctaaggcaggaaagaccagcgggaacgaccgcaagattatgggtgagttcctgaacttctgtccgattatctccatcgaaggctccaagatgagccagttcgatgtacccaagatgttggagcagcttaaacgtgtttatgtggaaagagttgtccgcaacggtttcgaggacaagagtctgtataatgatgagttgatgaaactcaacgacttggaattgcaggagtttgacgacctgaaaaagattatcggccagaccaaggcaatgccaaagaccaatcaggtggacatcaacaaccagggactgaccgatgagcaatacgaggaacttgaagaccttgaaaagaaatccaagaaacgcggtaaggacaagcaacctttgacggaagaagagaagaagcgtcttgaagagctgaaaaagaaaaagaacaaccgcgaggccgctatttctattcttcggggtatctccatccgtatgccattgcttatctacggtgcagagttgagcgatgagagtcaagatataacgattgataacttcgctttactcattgacccacaatcgtgggaagagttcatgcccaagggtgttaccaaacagaagttcaacagcatcaagaaatattacgacccggagatattctgtgcggcaggcaagcgcatccgtgccatggctcgtgctgcagacaaacttagtgtggaggaacgcatcgaacgtataacggatatattcagcacgttccgcaatcccgacaaggaaacggtgcttacgccttggcgtgtcgtgaatatgcaccttggcgactgtttgggtggatataacttctttgaaaaggactatgagaccaccttgtctgaccctcgtttcattgaccgtggtgaagtaactgccaatgtgtttgcccccgattcccgaatccttgaaataaattcaaagtcagggttataccctctttacatggcatacagcatttaccgtgcaaggctcaaggactccctgttttcggtgtcaagcattgaggatgaacagcgtatatgggacaaggttgtcgccgaaaacatctttgtcatctgcaaaactccgatggcaaagagcatcaccaaacgcactctcatcggcttccgcaaagcaaaggtaaacacccgatactttgaggacttaatcaatcaaatcaagaacaaaccggaacatttcatcaggcaggtagataaattcattacggatagaacaggaataaagaatatgaaaatcaatgcgatagtgggtaatccgccatatcaagaggttgttgcacaaaaggaaactgcaaatgggcaaaaagttagtgttagtatattccaatactttcaaacaataagcgaccgattaggtagatacacttctcttatctatcccggagcaagatggattcaccgttccggaaaaggacttgaacagttcggacttacacaaatcaatgacccgcatttgtgcttcttgaagtttttccctgattccatggatgttttcaaagaagttggtattgcagacggtttgtcaatagtgatgaaagatacgcaaaagaagagtaatggatttagatatgtctatgctaaaaaaggtaaggaagtgacgattgaagccaataatccgaaagaagaattattttctttgaatcctcttgatagtgaaatctcatattctttgaattgcgctataataaaatataggtgtttacatgatgccatattacctcgtagtctgttttctattgaaagtgatttcgtagaaaagaatcctatgttagtgagagaatataacgatggagattattttgacccaaaatcagaaataaaacttttcacaaatgacaaagcaggtaagagtggcagagccagatggtatattgcaaacaaagaggttctcactacagggcttgaacacttaagcaaatggaaagtcatcgtttcaagtgccaatgccggaggacaaaagcgtagcaaccaaattgccatcgtagataatcacagtgcatttggtcgctctcgcgtagcattgaaaacattcgctacagaacaagaggccaagaactttttcaaatatgccaccagcgagataatccgctttgctttcctgcttaccgatgaatctttaacctctttggcaaagaaggttccagacttattggattacactgacgctaacggtatcattgattacaatggagatgtgaatgctcaactttataaattgttgggtattgatgataggaatcaacagcatataaaagaattactctcacaaaaatgagatttttgtcgtacataaaatgtacctagattttatatcaagcaatttcatgactaaactttcggtgtccacacttcattgtggacaccgaaagtttagtcatggatatactgtttaatcatattgtcaaaatttgttctaaactcttgtgcctcctcagaaattgaacttaaaaaaggattaaggactttacaaccgtttcgcccccaatattctaattggctattaaaccatttttttgcattttggcgccccagttcacctcctgcatttatttgttccatggaatactctcggaaacagaattgttttgtgtacccatctgcaatcttagaccataatgggtctacatcagatagattatacaaataagaggccaatagtctttctggagacttatttcccggtaaaatcaaaatgttatctgcattgttgattttcctgagatcatttttattcattctaacatccccatctaatataacaatagaatatggatatataaaagcaggcactcttttggttacaagttccattaatgttgaacatggtaatgttacatccacaaaatccaacacaaaagccttgctctttaaaatagcttttacaaataagatattttccttgtcttccgtatatgctgtaattctgtttttcttgcgattatttccttctgcaacaacatttaaatccaattgaatgcctttgaagttcacgccctgtttaattgcaatcttatcatcaaccttcttaaggtaaaggatctttgcttgattggctgtttcttcttttttagttacttcttgaactaaatcatccattgccttaagaagagacattgaatgagttgtaaataaaatttgcaaattcaacttagatgcatatttgcgcaaaacctttaacaactctacttgggatgcgggatacattgttgcatccatctcatcaatggccaaaataccgcctttgtattgtcggggatatttgtcatgtaatcttttaaaagaaaataacgccaagataattttacctaaattatcttgccccatagagttttgattccaatcgtatagttctgtggatacacctatagattgcttgttttttgatgtgattgttgttgcggaagaaatgggagtttgtgctattagaattttattatgcaattgcttaaactcatttagttcttcttgcgttaataatgtatcatctgtaatgattttagcttcctctgccactggaactaatcgctttagacttaaaaagattgtggggaaggaaatgtatccatctccttcttgcctagctccttttttccaaaaacggacattaggatctcctgttcgtttgatactttcaacagtaaaatcatccattcctgcatcaaaggaaatagtccattcatgaccttttggtttatcaaaagtaggtgataacctaaacttatctttgaatgcggaaatataactaccaccacacaagggcttttcaactctcatagaatcttctgtcttaagagtgaaagtttgtgttataataccaagtaatgttgacttttgagttccgttttgccctgcaattgctgttaacaaagagcctacttcaaaatcttcattttgaaatcctcgaaatctttcgatatgaatgtgcgttattttcactttgtagaatggttaaatagtttgtgtttggggataactatgccatcgcaaaataccattatctctttacctttcccggaattactcgcactataattcaattcaaaacattgctgtctatattttgaatataggctggttatgaatggtacattatcataagagacaatccacttacaatttgcaatctcacttatagtgttagctatattttgatgatctgtatcattatagtaattcagataaagtcctttaccttttacatagtatggtgggtctaaataaaataacgtattatacggtaattcattttttaaccgttgtactaaagaaacagcatcttcatttgttaaatggattctatctgcataatctgctatacgttgaatcctttttatcaaatcttctttgttgaatcttgcatcaatcttataatttccagtttggtcataaccgccaatgactcctgctttcaagattcctgagcgattagtcctattcaagaagaatgtagaaaagcctaattctaacaagtcagaattctctttattggattgaatttctttttgtttaaaccaagtttcaacatttaaaggggtatcctttatcatcttgcagagagcatccacgttatttaaggcactataccaaaaggcataaatagatatatccttatcatttatatgtatgtcgctgacatattcattaaagagcaaagataatgcaacggaaccacctccaacatatggttcaacataagtgccatcgagcaatgcgttttctttgattaagcattgtacgaaatcagcaactttagccttaccgccagggtatcttaaaggtgatagaaattccataatattattctttattctttattgattcccacaattggataaaaaaactttctatgttgtcccatccagtaatcaaattatctgctttagggtagaaaaactcgttatgaacatatgcattcaatgattcgattgaaagaactgaatttttatcatttatttcagaccttatgccctttgataagtcattactcattgttcctaattgggtcatatgatttaagactttaccaactttcccttgcaaactttcaccagaagaacaagctgtaatagcattgtttcttactaaatcaaatttctccaaataggcatcaacagatagttctaaaaatactcttaaaaggactgaagatgcattggggcatgtcttgacctgaacatgttttagctcctcgaaaattttattaattttcgggttgctgatatgtaaattcaaagacttgggcactaaagctcctctgtttcttgttttcctgtttttatccccttttatttcttgtttctcgctatttcttgatgcttgttctttattgttctcaatatcttgaacactccattgttcagatgcttcattagacaaatctggcttttgactcttgccaaaattatcaatatattgctttcttttttctctgttatagatatcagaaactttgaattccggattcagaatgtctgtaacaacttttaaaagccccttaatgacttcggacactttaacctttgaaactaaaattccattgttaatttccaagccaaggtgttctctaacatatggatccgacatcaaacgttgcaagttggtaatgtttaatttagataatgaatccttaatcgtatcagaaacctcttcttgtgatttcagcaaagtgataatttgcaatggaattgatgattttccttctgtcttctcctcgaatctttgcttttgttgagcgttccaagtgacagttccgataccattaagttctccagagtgtttacgttttatccatatatcagcttcagtaggggtttcaaaaacagcacaagcaatattcttcaattcagaaatagcattaggtttttctttttgtaatttctgaaatttcttccttaaaggagagtatttgtcatctattagtgtcggattatttaatagttttaatgacgttattcgcctatttccttcaagtacaacatacttattgctgtcttcgttgggtgttacaataatcaaatcgacggggctaagaccattggttacaatatcgtccacaagagaatataatttatccccttgatcctctatcatcttatctattgcttctttttgtgatgataaaggctcaaatctataattttccgtattgacaaatagtgatgtcaattttatcgttcttataaccatggcaaaaccaatacttgttagtttgcaaagttactcatttttagtgaagttagcagtatttgaacaataaaaatgcacaggaatctgcgattttgcacgattttgcaggatgaagtttattgtaaatcaattctaatcactatctttgcattgcaaaaaggcgttcttttgatttaatgcaagacgaggtaaaatacagaacttcactcgtttccaaatcgttacctatcaagaaactaatctttgcaatctattcaaattcagcgacaaaggcaattcaatatgcctggcgcagtgaaacgtgatgttcttatctactcccgcttgcttggccacctttttcaagtatctgttcatcacctgattgagtggcacggggaatatatgattgttccgttttccttcgtgatatgcctcatacctttttaatatattaacggcaggttgtaataaaggcagtattgcgtgtatgtcagttttttgccgatagtagctaagccacaggcttttgtctatgccgacattaatattttcattggtaaggttctctatatcgacataggacaggcctgtatatacagcaaaaatgaagacatctctcacgatagacaggttggcaggcaaagggacctcctcaaggcttttcagttccttttcggagaggaatcccctttccacttttgttttcttggcattgagcaggcaaacagggtttcggcttatccattcgttttgcaaggctacattcatcacctttttgaaacgctggatatgctttaatgcaccattgactgcgcatacggtatccccttccctcctatacccttgaagataggcgtaaaattcataaacgaatgctttgtcaacagcagccaggtcataatcggaaacgtggtatttaatgcgtatgaaattgagcagatgttttttcgtgacgtgatagccaataaatgtactggtacggagattctttttctccatgatttcatggtagtcgaacagtgtgctgatcgtagagaactcattatcctgtgtctggaacatgagtttgaaattctcaatgttcaagggatagcttttctgcctgattttggcaatggtatcctcaatcgtgatcttcaaatcctcgatataccgattgacttctttatcattagcggttttcccgagcgacttttgcgcaaccgccgaccatgattctgagcgtagatgtagtttcgtgggaatttcgtatctttgccctgagatcgtaacccgacatgagagaggtgacatcttttcattcgttcttcctttccttatccagaaaagaacattgaaagtttgctttttttggttcatcgttgttttttttgagaatcactcaaaaaaatatcaaaaaagagcaatcgtgtcaccgaatttgtcaccgaattagcgtcaacttttttcgggtggcatttgtcaaagcatgaaaaaacccgctaaaattgcagttttagcgggtttttgtcattaaaaagctggtggtttgttgggctacctggattcgaaccaggaatgacaggaccagaatctgtagtgttaccattacaccatagcccaatgattttcgtttgcgggtgcaaagatacaaataatttgggaattgcaaacatttctgctattttttttgcaaaaactctcattttgctccttcaagtagaagcatctcccctaaaaaacacaaaaattaagtcataactttcttgtatccaataaatcaccgtatatttgtcaaaaatatcacgtttataatcagaaacaaagggtaatccttttttgttataaaccaaaagagaacatgaattattaatttcaattacaggaatgaacgatacgaaaatattaattgaaaaaattaaagagggaattcaggaaaaaaaaggtaaaaacatcattattgctgatttaaccagtatagaagataccatctgcaaatatttcgttatatgccaggggaactcccctagtcaggtaaatgctattgtagactctgtcaaggagtttgcccgtaaaggtgcagacagcaaaccgaccgcaatcgacggacttcgaaatgcagaatgggtggcaatggattattccgatgtacttgtacatgtctttctgccggaagtaagatccttctataatcttgaacatctgtgggctgacgccaaacttactcaaatccccgatttagactaatccacaattatggacaacaataatactaacaacaataacaataagcctaataataaggtgaatatgcccaagttcaatctgaactggctatatatgattattgccctcatgcttctcggcctttggtggagcagcgattcaagaggaagcggaagtaaagtcgttccttacagcgacttccagaagtatgtcactaacggctacatcagcaaagtactgggctctgagaaaactctcgaagctcatgtcaaaccgaatgccgtaggtgcaatattcggtgcggactccaccaaagtaggaagaaacccaattattaccagtaaccctccttctaaggacaggctggataaatttctgcaggacgaaaaagcagccggtcattttgacggaatagcagattaccctgccgattcggatattttcccggcaatcctgattaatattcttccgctggttttattaatcgccctgtggatattcttcatgcgtcgtatgagcggcggtggcggcggtggtgccggcggtgtattcaatgtaggaaaatccaaagcccagcttttcgaaaagggaggctccatcaagattacattcaaggacgtagccggcctggcggaagccaaacaggaggtagaagaaatcgtagagtttctgaaagaacctcagaagtatactgacctaggaggtaagattcccaaaggcgcattgctcgtaggccctccgggaaccggtaagacattgcttgcgaaggctgttgccggtgaagcaaacgttccgttcttctcactggcaggttctgacttcgtagaaatgtttgtcggtgtaggtgcttcccgcgtacgtgacctgttcaagcaagctaaagaaaaagctccttgtattgtctttatcgacgaaattgacgcggtaggccgtgctcgtggcaaaaaccctgcaatgggtggaaatgatgagcgtgaaaacaccctgaatcagttgctgactgaaatggacggcttcggctccaacagtggtgtgattatccttgccgctaccaaccgtgtggacgtacttgacaaggcattgcttcgtgccggacgtttcgaccgtcagatacacgtagacctgcccgaccttaacgaacgtaaagaagtattcggcgtacacctgcgtccgatcaagatagacgatacagtagatgtagatttgctagcacgtcagactccgggattctccggtgcggacattgcgaatgtctgcaatgaagctgccttgatcgcagcccgtcacggaaagaaatttgtaggcaagcaggattttctggatgcggtagaccgtatcatcggtggtctggaaaagaagaccaagattaccacagaagcggaaagacgctcgattgccttgcatgaagcaggacacgcctctatctcgtggttgctggaatatgcaaatccattgatcaaggtaacgattgttccccgcggacgtgcattgggtgctgcctggtatctgccggaagaacgtcagatcactaccaaagagcaaatgcttgacgaaatgtgcgctaccctcggaggacgtgcagccgaagacctgtttatcgggcgcatctctaccggtgctatgaacgacctcgaaagagttacgaaacaagcatacggcatgattgcttatttaggtatgagtgacaaactacccaacttatgctattataataatgaggaatattctttcaaccgcccgtatagcgaaaagacagccgaactcatcgatgaagaagtgaaacggatggtgaacgagcaatatgaacgtgccaagaagattttgtccgaacatatggaaggacacaatgaactggctcagttactgatcgacaaagaagtgatctttgccgaagacgttgaacgtattttcggtaaacgcccgtgggcatcccgctcggaagaaatcatggctgccaaagaaagccaggatgctgccagagcggaaagagaacttgccgagaaactgaaagcagaagaacaagaaatcaaagaagaggaagctaaaaattctgctcaggaagaagcaactacagaaacgaaaatcactgcggaaggaaaaaaagtaaccgtagaaggaaaagttactatagaagcaaaatccaatgagaaagaacaaactaccgaatctaaataattaaaacacgaagattttgattagtaattttataaaacgggccattacgggtatactctttgtcgccattctggtgggatgtatactctataattctttcagcttcggcattctgttcatggcgatcagtgcactgacgatctatgaattcggacagttaatcaacagccgtgcagaaggagtcaacgtaaacaaaaccattatcatgctgggaggagcttacctgttcctcgcagtgatgggattctgtatcgacgcagccgactccaagattttcattccttatttgctgttgctgctctatttgatgatcagcgaattgtatctgaaaaaggcaagttcaatgcttaactgggcatattccatgctcagccagctttatataggcctgccgtttgccttgcttaatgtcttggcgtttcatactgatccggaatatagcagcgtaagctacaatccgattctgccattgtccatctttatattcctttggctgagtgatacaggtgcatattgcgtcggttcattaattggcaaacaccgcttgtttgaacgtatctctcctaaaaaatcatgggaaggttccatcggcggcggagtagtagctatcggagcttcttttgtcttggcacattacttcacgattatgtcgatgtgggaatgggcaggtctcgctttagtcgttgtcgttttcggaacatggggcgacctgacagaatcattactgaaacgccagctgcacgttaaagattcagggaccattcttccgggacacggagggatgctcgaccgtttcgacagtgctttgatggctataccggcagcagtcttttatctgtatgcactaacttggttttaataacagaataaataaaataaaaggtcggaagccgctttgaagcacttccgacctttttttttcacacacagtgttcgtcaaggtttaggtttagttatttataaaagttttgctatttaacaaaagaagtagaatgcacatctttcgctttttccggaacgcctaccggatgatccaaatcaagaacgatcactcttccttctccattttcttttgaattaatagtcaccttaaatcctttaaattctgtttcagctgcatcttttgccgttggatagaactcttccagattataagaaactcgtccccatccccggtatccagttacatcatcatacgtattgtaacgtaattccagatgtatatacccatcttcatccacattcaaagcttccggtgtttccggagcttccggttctatcttattctgtacaagactgatgcggtgcttttcagaacgaggcaaatactgatggaagatgatattcaaaaactttcctcccagccacatatctccttgataaatcacgataggatcattaccgaattcctcttcattttcagccgtcatatcttccacctcttttgtcaacacttcctgaattccttcaatctttacctgagcacccttatccgtatcagccaaaggattgaaaaaagcaactactcgttcaccgtctaccggtttgtaccaaggaatagaactggccaccggatcaatcataccccaacgatcaccttccagataataaccaccgccaccggtggcacgaactgtagcccaatcccatcctatgtctccaattgagtacccatcgtcgtcacatgattgcagcgcaggtaccaatgcgagcaataacattactaaaagccaattaaattttttcatatttgttcctctctttttaattcttctgctatataaataaaaaagccgggcatttactgcaccggctttacgtttattcagaaaaagaaagttattttttcaacagttcaagcattttgcgagcggcatgctggggagcacctgcaggtcccaaccgatctgccatatactcatattcggcaagcatacgattcttatactcctgatcttcaatcagtttctttagttcattctgcatatttccgactgtcattgtatctgcaaccaactcctttacgacctcacggtctgcaatcagattgaccagtgaaataaatttcactttcaatatatgacgacgcaaaaacgaaaccacttttccaatcggtgtatagtaacaaaccacctgaggaacacggaacaaggctgtctcaagagtcgccgtacccgaagtggccaaagccacctccgcatgttgtagcaaacgataggtctgggcaaagattattttcactttagcctgccctacatattgcttgtaatactccggagcgatgccgggagcaccggccagtaccagttgataatcgggaaaagcagaagccgccttcagcatatccggcagattatccttgatctcctgtttccggcttcccgccaatagtgcgattatcggtttatcctccaggttattatccgccaagaatgcttccggatttttgggatgagctttctgataggcagtcacttcatctaccgtaggatttcctacataatgtataggatagcggtgtttcaaagtataaaactccacttcaaaaggaagaatggagaaaagttcatccacatcacgtttgatattctttatgcggtactctttccatgcccatatcttcggagaaatataatagaagacaggaatctgcgtctcggaatgcacaaacttagctatgttaagattgaaaccgggataatcgaccaagatcaccacatcgggattccaggccacaatatcttccttgcaacgtttcatatttgcaaagatcgtacgcaaatgaagtagtacagggataaatcccatatacgccagttctttataatgcttcaccatcgttcctccgacggcagccatcagatctccgccgaaaaagcggaaatcggcctgaggatcttccgccttgagggccgtcatcaaatgggacgcatgcaagtctccggaagcttcaccgacaatcagatagtacttcatgggaattttgaattaggagttttgaaatttgaaatcagcacaatgcgtatgtcagaattccagttgctgacaatagccattcagttcatctataaagccataagcagtcatatcgactgtcgttggcgtgatagccacatatccgttttccagcgcccaatgatcattattctcgttttcaagttcatgatcggtgaatgaaccggtcagccaaaagtaattatggtcatcgagacgggggcaagttacccattcattcacccagcatccctttgcctgttcgcaaaccttcactcctttgaggttgggagtatcgggaaagttcacattaagacaagtcaacgggggcagtcctttttccaatatcatggcagctatcttgcgtatataaggacccgaaggttcaaaatcagcatcgggccgatgattgcacagagaaaaaccaatcgaaggaattcccttcagacagccttcaatcaccactcccatcgttcccgaataatgcacgttaatagcggaattatctccatgattgataccgcctacgatcaggtcaggcttccggtcgagcactgagcccaatgccagcttgatacaatcggtcggcgttcctgtacatttatatacagtcagtcccacttctcttttgaccagttgataatgaaccggatgagtcaccgtcaatgcactgccgctgccggagcgcggagagtcgggtgccattacaacaatttcccccaacggacgaaggaacttcaccaattcactaatacctttagccataacaccatcgtcattcgaaacgaggatcaacggcttcttactttccatatattcaatcctttcctttttaatgttcgcacaaaagtagcaaaaagtaaccgtactgccaaccgcttatctccgaatatcacattaatcacatcgctatctgacgaatatacacccgtttacaaatcttaatcttctgcaagcgagtaaaaaaagaaatagatatccaatataaatatgtatatttgcaagctcaaacagagaaagtatgatgataaaatcaaccaggtttcggaactgtttcgtccggcagttattaacaaaaccggtgacttatcaacagaaaatgcaaagtttctcttttttcgtaggcgctctaaggaattatcacttatttcgctgccaataaatttagagtatatgggaaaaataattgctttggccaatcaaaaagggggtgtaggaaagaccacgactacgattaatctcgcagcgtcacttgctacacttgaaaagaaagtactcgtggtagatgcagacccgcaagcaaatgcctcttccggcctgggagtggacatcaagcagtcggaatgcactatctatgaatgcattattgacagagccaatgtacaggacgctattcttgacacagaaatcgactctttgaaagtgatctcttcgcacatcaatcttgtaggagcagagattgaaatgctgaacctcccaaaccgcgaaaagatactgaaagaagtgctcacacccttgaagaaagaatatgactatattctgatagattgttctccttcactcggactgattaccatcaatgccctgacggcagccgactccgtgatcatccccgtgcaagctgagtattttgctctcgaaggcatcagcaaactgctgaatacgattaaaatcatcaagtcgaaactgaatcccgctctggaaatcgaaggtttcctgctgacgatgtatgactcacgtctgcgtcaggcaaaccagatttacgacgaagtgaaaagacacttccaggaattagttttcaacagcgtgatccagcgaaatgtgaaactgagcgaggctcccagctacggtatcccgaccattctttatgatgcggactctaccggtgccaaaaaccatctcgcccttgccaaagagattatcaacagaaataaataaccgaagaagatatggcaacacaaaaaagaaatgcattaggacgcggacttgacgccctgctctcaatggatgatgtgaaaaccgaaggttcttcttccattagtgaaatagagttggcgaagattaccgtcaaccccaatcagccacgccgcgaattcgatcaaacggcattgcaggaactggctgattccattgcggaaatcggtatcatacagcctatcactctacgcaagctctcggacgatgagtatcagatcatcgcgggagagcgtcgttaccgtgcttcacaaaaagcaggactgaaaaccatccctgcctacatccgcactgccgacgacgaaaacatgatggaaatggcgctgattgaaaacatacagcgtgaagacctgaatgcggtagaaatagcattggcttatcaacatctgctggaccagtatgaactgacacaggaacgcctgagcgaacgtatcggcaagaaccggaccactatcgccaactacctgcgtctgctgaaactgccggctcctatacagatggctctacaaaacaaacagctagatatgggacatgcacgtgcattgatttcattaggcgaccccaaacttcaagtaaaaatattcgaagagatacaggaacacggatactccgtccgcaaagtagaagagattgtcaaatcgctgagcgaaggagaagctgtgaaaagcggcacacggaaaatcactccgaaacgcagcaaactaccggaagagtttaatttactaaagcaacaactcacgggatttttcaacaccaaggtacaactgacttgctccgaaaaggggaaaggaaaaatcagtattcctttcagcaacgaggaggaactggaacgtatcatggaaatcttcgatacgctaaaaaagtagatgacaagaaaaagtaagaaatatcagttacccatcatcaccctgcttctctgttttctacaggtggcagggattgatgtgtatgcacaagaacctgtgactccggtacagaaagacagtattattcagagccgggaagcaccgaaagcacgtgcacgaaggcaccgggatcctgctcaggtgatggattcgttgaaaaaggattcaatcaaaatattgcatccggaacgcctgcaagcaaccgacagtctgtctgctgtcaaaatacagatagccgacagtcttgacgcagccaataaaaaagaactgaagaagatagaacagccggcacctattgtagtgaaaaccgacacagtacctcctgtgcaggatctcaacaagaaactgttcattcccaacccgaccaaagcaacatggcttgcagtcgtattccctggcggaggacagatttacaaccgtaaatactggaaactacctattatatatggagggtttgcaggatgtgcgtatgccctcagctggaacgggaaaatgtataaagactattcacaggcctatctggacatcatggacagtaatccaaacaccaagagctatgaagatttgctgccaccgaacgcccagtataatgaagagcaactgaaaaacaccttgaaacgaagaaaggactcgttccgtcgttttcgggaccttagtatatttgcatttatcggagtataccttatctccatcatcgatgcctatgtcgatgcggaattatcgaacttcgacatttcacctgacttgagtatgaagctggagccaactgtcatcgacaataacagccagttccgctccaacagttacaagaataagtcagtgggactgcaatgcgtactacgattttaaaaacacaatttagattgaacttataattaaagcatgaagaaattagaaaactattgttcgattattttccttttcctgttggcaaccacacaggtaaaagctcaaagtgtagatgtagttattcgtgaaaacggaaccgaacgcaaagaaagcatcgatcttccaaagagtatgacttacccgctcgacagtctgctgaacgactggaaagctaaaaactatattgatttaggcaaagattgcagtacggcggaagtgaatcctttattcagtgattctgtctacattgaccgcctttcacgtattccggctgtcatggaaatgccttataatgacattgtacgcaaattcatcgatatgtacgcgggtcgcctgcgcaatcaggtttcattcatgctgagcgcctgcaatttctatatgcctattttcgaagaagcactggacgcttacggacttcctttggaactgaagtacctgccgattatcgaatctgcactgaatccttcagctgtgtcacgtgccggtgcttctggactgtggcaattcatgattggaacaggaaagatttacggtcttgaatccaatagtctgatagacgaacgccgcgacccgatcaaagcaacctgggctgccgcccgttacttgaaagagatgtacgatatttatggagactggaatctggttatagcagcctataactgtggcccaggtactatcaacaaggcaatccgccgcgccggaggcgaaacggattactggaaaatctataacctgctgcctaaagagacacgcggatatgtacctgctttcatcgcagccaactacgtgatgacatactattgcgaccacaacatctgtccgatggaaacaaacattccggcaagcacagatacggtgcaagtcactaaaaaccttcatttcgagcagattgccgaactttgcaatgttccgctggaggaagtgaaaagcctgaatccccaatacaagaaacaagtgattcccggcacgaccaaaccttgtacattacgtttaccacaaggtgccatcagtacgtttattgacaagcaagatacaatctacgcacaccgtgccgacgagctattccgcaaccgcaaaaccgttgcagtgaaagaagttactccaaccacccgcagacagacaagcgctgttgccggtaaaggaaaattaacttattataagataaaaagtggagacactctttcatcgattgccgaaaagctaggcgtacgtgtcaaagatatacagcagtggaacggtatgtcgaacaccagaatcgcagcaggaaaacaattgaaaatctacaaataaatgacttcccgcttgcttcattcggaaatttgcttatttttgcaaaaataagcgaatgaaaggataacgaatatggataatataacccccaaagaaatagcagatgaagagatgatcaatcaggcgttccaggaacttctgaatgattatctccatactaaacatcgcaaacgagttgaaatcatcacaaaagctttcaacttcgctaatcaggcacacaaaggaatcaaacgccgatccggcgaaccttatatcatgcacccgattgccgttgcacaaatagtatgtaacgaaattggtcttggttctacttctatctgtgcggcactgctgcacgacgtagtagaagacactgattacacggtagaagacatcgaaaatatctttggaccgaagattgcccagattgtagacggactgaccaaaatctccggagggatcttcggtgaccgtgcttcggcacaggcagagaacttcaagaagttactgctcaccatgtcgaacgatatccgagttatcctgatcaaaatagccgaccgcttgcacaatatgcgcacgctgggttccatgctgcccaacaagcaatataagatagcaggagaaactctctacatctatgccccgttagccaaccgcctaggtctgtacaagataaaaacagagcttgaaaacctcagcttcaaatatgaacaccccgaagaatatgccgagatagaagaaaagctgaatgctaccgccgccgaacgcgacaaagtattcaacgacttcacagctccgatccgcacccagctggataagatggggctgaaataccggattttggcacgtgtgaaatcgatctactccatctggaacaagatgcagaccaaacacgtcccgttcgaggagatttatgacttgctcgctgtccgcatcatcttcgaaccacgcaacgtggaagaagagctcaacgactgtttcgacatctatgtctccatttccaagatatacaagcctcatcccgaccgcctacgcgactgggtaagccacccgaaggcgaatggttaccaagcattgcacgtcaccctgatgggaaacaacggacaatggatcgaggtacagattcgcagcgaacggatgaacgatgttgcagaacaaggctttgccgcccactggaaatataaagaaggaggaggcagcgaagacgaaggtgaactggagaaatggctgaaaaccattaaagagatactggatgatccgcaaccggacgcaatcgactttttggatacgatcaaactgaacctgtttgcttccgaaatcttcgtgttcactccgaagggagagttaaagacaatgccacaaaactctacggcactggattttgccttctcactgcacacagatatcggtagccattgtatcggcgccaaggtcaatcataaactggtgccgctaagtcataaactgcaaagtggagatcaggttgaaatattgacctccaaatcccaacgtgtacaaccgcaatgggaggtatttgcaacgaccgcccgtgcccgtgccaagatcgcagcgattcttcgcaaagaacggaaagcgaatcagaaaattggcgaagagctactcaacgagtttctgaagaaggaagaaatacgtccggaagaagctgtcatcgagaagttgcgtaaatttcacaacttcaagaatgaagaagagttactggccgctatcggcagcaaagccattactttgggagaagcggacaagaacgagctgagagaaaagcaaaccagcaactggaagaaatacctgacgttctccttcgggaacagcaacaaggaaaaaccggaagagaaagaaccgcaggaaaaagaaaagatcaatccgaaagagattcttaaactgaccgaagaaagcctgcaaaagaaatacatcatggccgaatgttgtcatccgattcccggtgatgatgttttgggttacgttgatgaaaacgaccgcattattattcataaacgccagtgccctgttgctgccaagctgaaaagcagctatggtaaccgtatattagcgaccgaatgggatactcacaaagaactttctttcctcgtatatatctatttaagaggtatagacagcatgggacttctgaatgaagtgactcaggtcatttccagacagctcaacgtgaacatccgtaaacttgccattgaaacgaatgacgggatattcgaaggaaagattcagctatgggtacacgatgtggaagatgtaaagacaatctgtaataatctgaagaagattcaaaacatcaaacaggtgaaccgggtggaggaataatttatcgtccgtccagttctttcttgatagccagaagctcttccttaatacctttcagacggttcacaatttcgtaattgcgaaccgtggcttccttattatccttcaaccgttgacgggcaccgggaagcgtcagacctttctccttcaccagatgatagatcagaccaatcgtttccacatcctcctttcgatactgacgtatccccctccccgttgtcctgggagaaatctgcgggaactccttctcccaaaaacgaagcaaggatgcattgactccaaacatatcggccacttcggctatggagtaatataattttagttctttgtccgtattcagcatagaaatcgttgttttaagagattaatcgaacactttaccgtgattggcggctagttgaatcatcttctcataatcttccgcactcaagtccatgaagtaatagttgacaggattcacaacctttcccttcacgtgtacctcatagtgaagatgaggaccggtgctcttacctgtacttcccacttttccaatcacctcgccacgcaccacctttttcccaactttcgtgttatagctctgtaagtgagcgtaccgagtcagataaccgaagccatgatcaatctcaatcgtattgccatatccggtttcccatcctacttttaccactgtaccgtcaccggtcgcatagacatccgttcccggatgagcggagaagtccattcccgaatgaaacttcgtcgtaccgtaaatcggatcaatacgtgttccgtatccggaagcagtcttgcgaaggtctttattggagataggctggatagccggaatacatttcagcatttcatcatgattcttacacatatccaccacgtcatcgaaagatttggactggatataaagttgtttggacagtacatccagcttttgggtcgtatttaccaccagcttggagtttgccagatccatcagctcctcataccggttcgtacctccaaaacctgcctgacggatagccggcgaaacaggatcagcttgcagaatcacccgatacaggttatcgtcacgctgctgaatatcctgcagcacccccatcgcatcatccagacggcgggaaagtacattatattgcgccaaaagacggctattttcgattcgcagctccttctccgaaggcgatccgaacactagaagcaagacgatgaagcatccggctccaagtcccataccgataaaaagccggcgcagaatgctaagtgcacgctgccgtacggtagggtaaattcggtcataagtctgcgtccttggattgtagatgtagtaaactttgcgcatctttttggaaatatttcgcttgttaatacggcaaaagtaataaaaacaagctatctttgcacagttttttgagaatattaacctcaacaatagatatatagaagaatatgttgactgcaaaagagatcagagattcattcaagaatttctttgagtcgaaaggacaccacattgttccctcggctccgatggtgataaaagatgaccctaccctgatgtttaccaacgcagggatgaaccagtttaaagatattattttgggtaaccacccggccaaatatcacagagtcgcggactctcagaaatgtctgcgtgtaagcggaaagcataatgacctggaagaagtgggacacgatacgtaccaccacaccatgttcgaaatgctgggcaactggtcattcggtgactacttcaagaaagaagccatcaactgggcatgggaatatctggtagaagtattgaaactgaatccggaacacctgtacgccactgtattcgaaggaagtcccgaagaaggactgagccgtgacgacgaagccgcttcttactgggaacagtatctgccgaaagatcacatcatcaacggcaacaagcacgacaacttctgggaaatgggtgatacaggtccttgcggaccttgttcggaaatccacatcgacctccgtccggcagaagaacgtgccaaaatctccggccgtgatctcgtcaaccacgatcatccccaagtgattgaaatatggaaccttgtgttcatgcaatataaccgtaaagctgacggcagcctcgaaccacttcctgcaaaggttatcgatacaggtatgggattcgaacgcctctgtatggctttgcagggcaagacttccaactacgatacagacgtattccagccgatgctgaaagcgattgcagcaatgtcaggcacagagtacggaaaagacaaacaacaggacatcgccatgcgtgtaatcgctgaccacatccgtacgattgctttctccattacggacggtcagctgccttccaatgccaaggcaggttatgtaatccgccgtatcctccgccgcgccgttcgctacggatatactttcctcggacagaaacagtcattcatgtacaagctgcttccggtgttgatcgacaacatgggagacgcttatccggaactgatcgcacagaaaggtctgatcgaaaaagtaatcaaggaagaagaagaagccttccttcgcacgctggaaacaggtatccgtctgctggataaaacaatgggagatacaaaggccgccggaaagacagaaatcagcggtaaagatgcctttaccttatatgatactttcggttttccgttagacctgacagaactgattcttcgcgaaaacggaatgacagtcaacatcgaagagttcaacgcggaaatgcaacagcagaaacagcgtgcacgtaacgctgccgccatcgaaaccggtgactgggtgactctgagagaaggaacaaccgaattcgtaggttacgactatactgaatacgaagcatctattctccgctatcgtcagatcaagcagaaaaaccagacactgtatcagatcgtacttgactgtactccgttctatgcagaaagcggtggtcaggtaggcgacaccggtgtattggtcagcgaattcgagaccatcgaagtgattgacaccaagaaagagaacaatctaccgatacatattaccaaaaagttgccggaacatccggaagctccgatgatggcttgtgtagacaccgacaaacgggcagcctgcgcagccaatcactcggcaactcacctgctggactctgccctgcgtgaagtactgggcgagcatatcgaacagaaaggttcgttagtaacaccggattcactgcgtttcgacttctctcacttccagaaggtgaccgacgaagaaatccgccaggtagaacacctggtgaatgccaagattcgtgccaacatacctttgaaggaataccgcaacattcctatcgaagaagcgaaagagctaggagctatcgccctcttcggtgaaaagtacggtgaaagagtacgtgtcatccagttcggttcttctatcgaattctgtggaggtatccacgtagccgcaaccggaaatatcggtatggtgaagatcatttccgaaagctctgttgcagccggtgtacgccgtatcgaagcatatacgggagcccgtgtggaagaaatgctggataccattcaggatacgatcagtgaattgaaatcgctcttcaacaacgcacccgacttgggtattgccatccgcaagtatattgaggaaaacgcaggactgaaaaagcaggtagaagactacatgaaagagaaagaagcctcgctgaaagaaagactgctgaagaatatacaggaaattcacggtatcaaggtaatcaagttctgtgctccgttgccggcggaagtggtgaagaatatcgccttccagcttcgcggtgaaatcacagaaaacctgttctttgtggccggaagcctcgacaacggcaagcctatgctgaccgtcatgctaagtgacaatctggtggccggtggcttgaaagcaggcaacctggtgaaagaagcagccaaactgattcaaggcggcggaggcggtcaacctcatttcgctactgccggaggcaagaatacagacggactgaatgccgctatcgaaaaggtactggaactcgcaggtatctaaaaaagcagtaacatacatccaatacaagaaccgtgtcttaaagtcacccgcactttaaggcacgtttttttatttcagattccagtgtcaacagcaactaatcagcctcctgccaaaaatattcgtgatataaactcaattatcacaactttttcctacctttgtaaacagattaattatttttcttatccttcaaataataaaataagtaatcaccaatacccgtacaccgatgaaaacacctatttacctacttctaatcgtttgtatttttgcatcctgcaacaccaaacagacacaagctgaaattgattacacatcgtatgtaaatccttttattggcaccgatttcacaggaaacacttatcccggcgcacaagcccccttcggtatggtgcagctcagcccggacaacggacttccgggatgggaccgcatctccggctatttttatccggacagcaccatcgccggcttcagccatacccacctttcgggaacaggtgcaggcgacttgtacgacatctctttcatgccggtcacactgccctacaaagaggcagaagcgccgctgggcatctactccaagttttctcacgatgaagagagcgcctatgcaggctactatcaagtacgtctgaaagactaccatatcaatgtggaactgaccgcaaccgaacgttgtggcatccagcgatacaccttccccaaagccgaagccgccatcttcctgaatctgaagaaagccatgaactgggacttcacaaacgattcgcacatcgaagtagtggactctgtgacgattcaaggataccgttactccgacggctgggcacgcgaccagcgaatctacttccgcacccgcttctcgaagcctttcgacaaggtggaactggatacgactgccattatcaaagacaagcaacacatcggtacggctgtcatcgcacgttttgacttccataccgaagaaggagaacagattctcgtcaataccgccatttccggcgtcagcatggaaggcgcagccaagaacctgcaagccgaagtgcccgaaaatgacttcgacaagtatctggcagaaacaaaagcaaactggaaccgccaactgggaaagatcgaagtcgagggtgacaatcaagacgataaagtaaacttttatacggctctgtaccactcgatgatcgcacctacgatttacagtgacgtagacggagcctattacggtcccgacaaaaaagtacatcagagtgacggctgggtgaattacagcactttctccctttgggatacctaccgtgccgcccatccccttttcacatataccgaaccggaacgtgtcaacgacatggtaaaatccttcatcgccttctttgaacagaacggacgcctgcccgtatggaacttctacgggagtgaaaccgatatgatgatcggctatcatgccgttcccgtgattgtagacgcttatctgaaaggtataggcaactttgatgcggagaaagcactggccgcctgcgtagctaccgccaacttggataactaccggggcatcgggctatacaagcaattaggctatattccttacaacgtgacagatcattacaatgccgaaaattggtcactgtccaaaacactggaatatgcatttgacgattactgcatcgctgagatggcgaacaagatgggcaagaaggagatagcggacgaattctacaaacgttctcagaactacaagaatgtttacaacccggccacttcgttcatgcagccgcgtgacgataaaggaaactttatcaaagacttcaaagccgacgaatacactccgcatatctgcgaaagcaacggctggcaatacttctggtccgtgcagcatgacatagatggtctgattgatctcacaggaggtaaaaaccgctttgcagagaaactggacagcatgtttacctaccatccggcagccgacgaagaacttcccatcttcagcacgggaatgatcgggcaatatgctcacggcaatgagccgagccatcacgtaatctatctcttcaatgccgtaggacaacagaacctgacacagaaatacgttgccaaggtaatgaacgagctttacaagaacgagcctgccggtctttgcggaaacgaagactgcggacaaatgtctgcctggtacgtattcagcgcgatgggattctatcccgtcaatccggtcagcggaaagtatgaaataggtactcccctgttcccggagatgaagttgcatctggctaacggaaagacatttacagtacttgctcccaaagtgagcaaagagaatatttacattcaatctatcaaagtagacggtcaaccgtacaacaagacctaccttacccatgaacagattatgagcggtaccaccgtcgaatttgaaatggggaatactcccttagtggaagtcgaatttgaagaacagacccagtaggtccacctaaactaatctatcggaaaaatgaatgaaaacttcgacttaacctacaaagctctattccgcaggtactaccccagcctgatattctatgccacccgactggtgggagaagaagaggcggaggatgtagtgcaggacgtgttcgtagagctttggaaacgaaaagacagcatagagataggagagcagattcaggctttcctctatcgtgctgtctatacacgtgcccttaacgtattgaaacatcgtaatgtagaagatggctattgcgccgccatggaagagataaaccggaggcgtgcagagttttatcagccggacaataacgaagtgatccgcaagatcgaagaccaggaattgcggaaagagattcacgatgcgatcaatgagcttccggacaagtgcaaagaagttttcaagctcagctatctgcacgacatgaaaaataaggagatagccgatgtactgggagtttcactccgcacggtagaggcacatatgtataaggctttgaagttcctgcgaaatcgtctcggacatctttggttcattctcctcttatttttattggattaaagataagtgtttttggggtttcagttgtattacttatatgaaggaaaagaaaatgagaaatctgagcgaagaaataataaacaaatatctgactggtcagtgttctgaagaagagctgatggaggtaaatgcctggatcagcgaatcggacgaaaatgcccgccagttgttccgcatggaagaaatttatcatctgggtaagtttgaccattatgccgatgaacagagaatggctaatgcggaaaaaaggctttataaacaactgtcgcaagagaaaaagaagaaagataaagtactgcatatgcatcgctggatgagatatgcggccatccttgccgtcgctttactaatgggcggaggagccggatattggttctacaaccggccggaacatcagatgctggtagccgttgccaatgaaggcatcgtgaaggaagttgtcttgccagatggaacgaaagtctggctgaacaatgccgccacgctgaagtacccgcgcgaattctccgaaaaagaacgtaatgtgtatctggacggagaagcctatttcgaagtgaccaagaaccgccataaaccattcacggtagaaagcgacgctatgcgcgtacgtgtactgggaaccactttcaacttcaaatgcgacaaacgttgccggatagcggaagcaaccttgatcgaaggagaaatcgaagtgaaaggcaacaaggacgaaggacaaattgtcctcgcccccggtcagcgtgccgaactgaacagaaacagcggacggctgacggtgaaacaggtcgacgcgaaactggatgctgtatggcgtgacaatctgataccattcaataaagcaaacatatttaccatcaccaaggcactggaacgcttctacgacgtgaagatcattctgtctcctgacattcggtcggacaaaacatattcgggtgtattgaagaaaaaatcaaccatcgaatcggtattgaaatccttgcagaattccatacctattgaatataaaatcgtaggaaacaacatctttatctcttcagataagaaatgagtcctgtgttaaacttaaactaataaacgacatgaaattaaagacacttctgataggatgtttcggaggatttataatgctcaactcctgcacagagtcccccagtgtaaaagattatagtgcttatgtcaatcctttcataggcaccggcggacatggacatactttccccggagctgtagttccgcacggtatgatccagcccagtccggacaccaggatcgacggctgggacgcctgctccggttattattacgacgacaacacgatcaacggtttttcgcatacccacgtcagcggtacaggctgttgtgactacggagacgtattactgatgccgactgtcggcaagccgcagtatctgacaactgatccggaaagccagaaactggcttacgcctctgctttctcgcacgagaatgagacagcggaacccggatattactccgtcttcctcgacacctatcaggtaaaagcggagatcacggctaccaagcgcggcgccatccaccgctacactttccccgaaagcacagaatccggatttatcatcgacctggactacagcctgcaacggcagaccaactacgagatggaaatcgaagtaatcagcgacacggaaatctgcggacacaagaagacgacttactgggctttcgaccagtatattaacttctacgccaagttctccaaaccgttcgcatataccctcatcaccgactctgtcacgatggacaacggcaagcgcctgcctgtatgcaaagcggtgctgcacttcaatacaaagaaagacgaagaagtactggtaaaagtgggtgtatctgccgtcgatatcgccggcgcacgcaagaatgtggaatccgaaattcccgaatgggacttcgacaaggtacgaaaagacgcccgcactgcctggaacaattatctgtctaaaatagacatcaccacttccgataaagaagataaaaccatcttttataccgccctgtatcatacggccatcagcccgaacctgtttacggatgcggacggacgctatctcggcatggatctcgaagtacatcagggagataccatcaatccgctgtatactgtcttctccctgtgggatactttccgcgcgctgcacccgctgatgacgatcattgacccgaatctgaacaatcagttcatcaattcactgattaggaaacatcaggaaggcggaatatacccgatgtgggatctggcttccaactacactggaacgatgatcggatatcatgcagtcccggttatcgtggatgcctatatgaaaggttaccgcaattttgatgctcacgaagcatacaaagccagtctgcgggcagccgaatatgacacgacaggcatcaaatgccccgatctggtgctgccgcatctgatgcccaaagcgaagtattataaaaacgctatcggctacatcccctgcgaccgcgaaaatgaatctgtagccaaagcattggaatatgcctacgacgactggtgtatctccatctttgccgaagcgatgaacgacttcgaaaacaaagcaaagtatgaacgtttcgctaaagcctatgagttctatttcgacaaatcgacccgtttcatgcgcggactggattcgaatggcgaatggcgcaccccgttcaacccgcgtgcctccactcaccgtagtgatgactattgcgaaggaaccgcttggcaatggacctggtttgttccgcacgatgtggaaggacttgtgaaactgatgggaggcgaggacgcttttgtagaaaagctggattcgctgtttacagtcgattcgagtctggacggagaaaccacctcggctgatatcagcggactgatcggtcagtatgcacatggcaatgagccgagtcatcacgtgattcatctgtacaactatgtgaatcgtccgtggagaacgcaggaattagtggacagtgtctaccggagccagtatgccaacaacgtagacgggttgtccgggaatgaagactgcggacagatgtcggcatggtatatactcaactcgatgggattctatcaggtatgtccgggcaaaccggtgtattctatcggacgtccggctttcgacaaagccgtgatcaatctccccggtgaaaagacattcagcatcgtggcgaagaacaactccaaaagcaacaaatacatcgaaagcgtattgctgaacggcaaacctctggacacgcctttcttcggacatcaggacattgtagcgggcggagtcatggagatcagaatgactgaccaccctacacaatggggagtcagacagtagccaacattccggatacctgacatcacgccgtcattcttcgctatgctccggatgacagcgtgatgtttctcaataatcatataaaccattacttatcatgaaaagactcttattaatagcctgtatacttaattgcacgctattgtcccaagccaaagactggacgcagtacgtcaatccgctgatgggttcccaatctacttttgagttatcaacaggcaatacctatccggctattgcccgtccctggggtatgaacttctggactccacagacaggcaaaatgggagacggatggcaatatacctataccgccaacaaaatccgcgggttcaaacagacacaccagcccagtccgtggatcaatgattatggtcagttctcgataatgccgatagtgggccaaccggtgtttgacgaagagaaacgggcaagctggtttgcacataaaggggaagtggcaactccttactactacaaagtatacctggcagaacacgatatagtcaccgaaatgacaccgacggaacgtgctgtgcttttccgtttcacattcccggagaatgatcattcttatgtggtcgtagatgccttcgacaaaggttcttacatcaaaattattccggaagagaataagataatcggttataccacacgcaacagcggtggtgttcctgaaaacttcaagaactactttatcattgagttcgacaagcctttcacctataaggccacggtagagaacggaaatctgcaagagaacgtagcggaacagacaaccgaccatgccggagcgatcatcggattcaaaacccgcaaaggagagcaggtgaacgcacgtatcgcctcttcttttatcagcttcgagcaggctgccgctaatatgaacgaactgggcaaagataatatagaacaactcgcccaaaaaggaaaagatgcctggaatcaggtgctgggcaaaatagaagtagaaggcggcaatctggatcagtaccgtacattctactcctgcctgtatcgttcactgcttttcccgcgcaagttctatgagctggatgcgaacggtcagcccattcattacagtccgtataacggacaggtacttccgggatatatgtttaccgataccggcttctgggatacattccgctgcctcttcccgctgttgaatctgatgtacccgtcggttaataaggagatgcaggaagggttgatcaatacataccttgaaagcggtttcttccccgaatgggcaagtccggggcacagaggttgcatggttggaaataactccgcatcaatcctggtagacgcctatatgaaaggagtaaaagtcgatgatatcaagacgttgtatgaaggactgattcacggaacggagaatgtgcatccggaggtttcttctaccggacgattgggatacgagtattataataaactgggatacgtaccctacgatgtgaaaatcaacgagaacgccgcccgtactctggagtatgcatacgatgactggtgtatctatcggttggctaaagaactgaaacgtcccaagaaagaaatcagcctgtttgccaaacgtgccatgaattacaagaatcttttcgataaagaatccaagctgatgcgtggtcgcaacgaagacggtacattccagtctcctttctcaccactgaaatggggagatgcctttacggaaggaaacagctggcattatacctggtctgtcttccacgatccgcagggacttattgacctgatgggcgggaaagagatgtttgttaccatgatggattccgtatttgccgtaccgcccatttttgatgacagctattacggacaagtgattcacgaaattcgtgaaatgacagtgatgaatatgggcaactatgcacatggtaatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggacaaacttctgcctggtatgtgttctctgcgctgggtttctaccctgtttgccctggaacggacgaatatgtgatgggaactcctctgttcaaaaaggctactcttcacttcgagaacggcaatagtcttgttatcgacgcgcccaataacagcacggaaaatttctatattgattccatgagcttcaatggtgctgatcataccaagaattatctgcgtcacgaagatttgttcaagggaggtactatcaaagtagacatgagtaatcggccgaatctgaacagaggaaccaaagaagaggatatgccttattctttttccaaagaatagtagttagttcatcgattaaattcacgttcctatattaggccctttttcttccggttttctgactttctctctgttctgaaagactttatccggataatggcaaaaaaaacgatagcctgaaagtaaacttctttactttcaggctatttttcagttagtattcactacttttgccggacaaacaactataaatcatggaagaagaaattgactttaccaaagtcccctatcagtacgcaatgtgcctcaatcgggaatgttcaaaagcaaacacttgcttaagactacttacagcacaaagcgtaccggaaaagattgaatactgggttattatcagtcccaaacatctcgctgcccaacaagggaattgtccttattatcgttctaatgtcaaagtacgttatgctaagggattcatcagaatgttagaagacttgccttataagcaaatgcaaactgtcatatcgcatttaatgagctattttggtcgcagaacttactaccgcatccgcaaaggcgaacgcctccttaccccctccgagcaacaaagaatattaaatatcctcaagaattgcggagcaactcatctacaaaactttgatgcatacgttgaagattatgactggtgatcggcagtaacacgaagtgatactactgttacgctcagaagacacaactgtcaccatttggtggcactgttgtcacatattggtgtcattgttgtgccaacggcttggcacaacaatgacaccgtagtggcacaactgtgccaagcccttggcacaagggttcccttacgaggagacagggagggacatagtagcttatacaagaaaagagccaggctttcaaaatgaagcctggctctaaaattaacttatctgctaatgactagactttactgagcgttgtagatataaacttcagttacatcaatatatgaaccaaagccttccaataattcaacctttacataacgagctgttatagaagagaagaattggaaataatgattacccacacgaggaacttccaacactccctgtggagtccagttttcattatccaatgaagttgaaatacgtactttcttagaagcatacgtataataataatccatacccaaagcattaaaagtctgtgctgatttcatatcaataacaaaccagaatggattataactatatacatctgatccatagcttcctccattaccatcaatcaaataactagctctaccggagacaccagaaggaatctccgcactccaacctgctttcgacaattcagtccagttactacctataacagacaaatatttaaagtttctaagtactttatccacattaaaggttaagaagttctccttactattaaccttcacaacggggtcttcactttctgctgatgcagtaacaacaagagtgtgagattcttctccagctgttgtcagcaagaaatcatcagtaatagtccaggtaacctctgctgattctaactctccggcagctatggtaatttcagcaggagtaacagtgatatcattcatgaactgttcatccaatcccgtagtggcaagtttcacttttacgtcttttcttgccggcttatccaacttcatcttgaaagtataggatataggatcaggatttacaatcgctccttgagagaaagcacgttcaaatgtaacgttattaccgctctcaccaaccacagagcatgaagctgtgtatgcctccttctctattacaactttagattgtattggttcagttcctatcttatatccttccacactggctttcacccctaattcataagtagtcgcatcataattggatgctgcaaaactaaaatcttcatccttcaaagtcacagtgacagaagcatctgttgaaccggcaggaagaactactttagtggcactgatctctacattttcttttgggatattagtatttataatatcaaaagtcactgtagcatcttccggtgatgcagcaaaatggaatgtataagttctagtgacagggccatctaattccaatgtaccatcagatttgtaaaccgcagtcaacgtcgctttagacgctccttccgcatcgtcaatcgttatagcaggctgattcaccggatatttaaccaaatccaccacctcatcatcctgacatccagcaaaagtaacgaatgatcctattgccagagataaaaagagtttataatgtgctttcatattcttgttttttatttgttcctattttatttaaagatcatccggatatttatatggcgtcggatcattcttcttgtagaatatagtcggtgctgctacattggacccgtacaatacttcgccaccaccttgaagacggctgaaaacactaccatatttagccggacttggagcaaatcccataaaccatccataccctccatctatcatactttgagctttagaggcagataaactaccgccaccacctaagttgaattccattgaaataccggagcattgtttctttgtcatttgtccgataggatatgcagcactaccatagttggctaccacaatatctatccattcttttgcatctaccccgtcgacagtagctacaccatacatctgtccccaatcaaatacagtaaccagtttatccggcattgcctgtttggtttcataacacagacgagctgcagcagccgtacttggattagtaagagacggattgctcaaatcaggactgtttgaatactcatcgtcataatttactccatccaagttatatgccttacaatactgagcaacttcgcgggcaaagtctttagcaccttgttcggaaagctgtgccaagcctgtaatgtcatggttaccaagcagtcctaacaatactttcacaccacgtctacgcagtggctgaagaagagtttcattattatccaacagatactgtacattcgggttacattgtacacgaggacgtcctgcttcagcatcatagttgatattagcagcaaacagtacaacaacatcccaaagaagttttccattctctaattggaaagaaagagtattcagcggatttacgtcatttacttcaaagaacaaataaccttgcattacaccttctcctttatatgcatcaccggcatttcgcatatctttcaccagataaatacaatgtttcgcatcttcatctttaatagtgatatcactactctgatcactgatagctaccggaatagcatatgttttatcttcctgcagaccttctcctgcccgaatagtcatctctacctccgctgatttagtattagcgttcactgtaagtattccttcgttagcaaaggtaaccaagtcctgcggatacaatgcaaaatctgtattatgcgccttattatacgtttccaaataagcagcatcaattttcacttttgccgatgtagctgtattaggtgtcttgctcaaccccatttttactgtagtagcataagtctcaccgtgcaattcgacaaccttagaaactaagttcgactttccatcacgcagatatgcattattttcataaatgccactgtaggccgactcatcaatattctttccgacctcaagatcatcagcacaagaggtcaagaatgcagtactgctcacaatcatggcagcgaacaaacccgaagttatatatttcatattcataatgaattcttgaataaaagattaaaccaacaattaatttatcttaggaatctctacttttacccaagtaggatcgcccgaacctgtaatatcattaccatgtccagtctggtcggtaataacatttccagcaccttcattaaacttccagtaagcaaccagtccttcactggcaggatctacttcataaggattagtggcaatttgctctgccgttctttgcactgaccacacgcggacttctgaaatatctcccggcaaccaacgagtatcatcccaagcgcgaccaatataacaaccactgctcaaagatacattacctgaagctgcttcgtctttataaacaggcacaccatctttataatagattcgttcttttgttgtattatcataaacaatggcaatgtgtacccactcattaaccggtaaacccggaacaacattcggacctgggaaattaccaccgggagctactacctgaacttgatcacgtggacggtcagcatcaccaatacgtacaaggaatttaccttcaataccgaaaacagaactcagggcattatcacgtcctgctacccagtcttcactacgaaccaaagcttcaatagtaacagtagaaagactattcacactgctcttccagttaattgggaaatagatttctttgatatttgccactacattaataagggcagcacccttaaatatgaaataagcagtacgggcactttcgagtacatcaatattggatgcatctagaatggtgacgggcaatacatatcgttttgacttatccaattcgttggtattcttaaagtcaatcacaatattatcactggaaatatcccctgccttaatagtagcagtttttgttggcatattataaaaatatgaatccagtgcagttgcgttatcattgtaaatcaaattatatgctgctgtcatagcgggagccgcatcaaagcttatttgaatatcttgttctgccggcgatgctatacgatagctaagttcacgggtagcctcagttatactgggcttaatcagcaaatcatcacaaacaggagccgagctaacatagagtttattgtcataatgatgctcttcattgatatcttcattcttacaaccactcactgtgactgttgtaagagccaaaagcgcaaaacaatatttatagagtttcatttctattcttatttattaggattcataatacgaataacttcacgcacatatccataagtattgttataataatcattatggacattcataataaagattcctttccgggtgtaattaggagatgcttcaaccatccactgggctgctcccggagctgctactagtttattgcctttttcatccactgtactccagtaacccttcactttatccttatcgtcagcctgcggcaattcgacacaaacgataaaacgatcagcaggaacaggattcactccttcttctgtaccgcctactgcatctatacccgcctgaatagccaaatatgcttttaaagcaagatcatcagcattggtagaagaagcagttttcaacatgatgtagtcaaacttgcttaacatatccatattctccggcactaaatattgtacatttccgtagaataccagagtcttgtcatcatgattgccttgccagttcatcacctcgcaaaaaaacttctgttgacggtcattatattctttcagagctgcctccggaaggctcaccagcgaacgccccgtataatcagcaataacaccatcaaagttatatttgtcacagagtgccaacatctcattggtgcgttcaccgatatactgaagagcatcctcttctgtcaactccggttcggcttttactttctccttccaggcattttcaatgctggaataatcaatactgtaaaccgtacgagttcctttctcgcgtattttgaccatttctgcctgtacttcgggacttacttccggattattcagacaaatgaaatcaacgctgtcaggtacgacggtcagacgttcagcctgcttgccgggagatcccttagggttctcgaaagaaacaaaagtgaccttatgttcttcagacttatatctgttcaaatccttcagatagtcagcatacaactgaggattctgctcttcaaatgtaggagtattcaattggagactttccacatctgtccaatcactacatgaagttattgtcagagctgatgccagaaacagcagagcagacaatctatatttcaggttatttttcatatatactttcctttaagtttaatattattttttagaagcccaccatacatctgtagccatgttatctgcaccgtgcaagtagttggcaatcgcatattctacatttgctttattgctgacaaactcatccaacggataaggcatacgacgcgcccctttctctgaatcaacgacaccaccgctcttattttctttcaccgggatcagtttcggatatccggtacggcggaagtctgcccaagcttcattacccaattgccagttggcaatccacttctgcacgataatgcgttcttgcttctcttctttgtcagcactatcattccatttaatagtgatattggacaaagcattctgataagtgttcgtacctgccgggtctgtatatgcagtcggtttgtttacatcatctttcagatagtcttccacaccgtctgcaccccattgctcaaatgacagacggataccttgattatagaatgattctgctgtaccacccatgctgaagttaaaaacagcttgcccttcagcacgtaagaaagctacttcggctgcattcatccaataaagcggagatgtaggagcaatgttcaccccagagtatttatgtccggttgtcttcagttcgggaatgacaataccacgacgcattcctacatagtcctgtcccgcccattcggattttgtgaagaacttttcacgtctgttatccttgtaaccattcatatagcagatgatatcggcagcagcatgcgtatcaccgccagtcaaacagggtacgccgccatgatcggaagtctgtacctgattgtagcgggtagctacataaataggattttgtgaagtctcaaagtagttccatgttgcattgtccgcattcgattcgatgacacctccgtttgcaggattcacagcttcttcagccatctgttgagctttcaccggattagcataagctatacggatagcaagacgcaacttcagtgagttggcaaatctgatccacttctttacatcacctttatatatatagtcggctgtaggaacgagctgttcgttagaattctcattgagtgtggcaatagctgcattcaactcatcgaagaatgtattatatgtcacttcctgagaatcataaggagtagcaatttcgccattcgcacctatctgagaataaggtatcggaccgaaagcatcagttacacgatgcatagctgccacctttatcacttgtgcaatggcataaggaaccggatcattcgtattttgtgatacaagtttcacttgggtcagattagaatataatgtcggaataatcttatcacttttcagaaacacacggctccagtcgtctttcggattgaagtttgaaatggtttctgtaaaaccggcattagaatcggcaaaatatccgcctaaaggtccgcccaacaagcagtctgtgaactgagctgtatttacatccggtgataccacgcaaccggccaggttattcatggcagatcccaaagcatatccatccgctgacaaatcaggagcttcatatgggttggaattgatattctcatagttaccgatacacgaggacaaggcaacggtaagagatccaaatactaatttatttattatatttttcatacctatcttgatttatttagaatttaaagctcagattaaagccaatattacgcaatgaaggcatcataaagtagtcaattccctgatagaagttatcagtagatgccacgctttcaggatcgaaaggagccttgttgtagatcatccaaagattacgtccgatcaatgaaactttgatatcacacacattgcccagccattttctcggaatagtataaccgatagaagcttcctgcaaacgaatattagtagcggaataaatataatactgaggaacagccgtaccaccagctactactgaataccagccttccggatttacacggtcgtttccatttaccgatacataacctttgtcacgtgcagcagcagatgcttcagaaactccgaagttatcaagaacagcttgtgtacgtgagaatacaactccacccagacgagctgatacaaggaatgccacattaatgtttttccaactgaaattgttacgccatgccaagtttcctttcggcaatacactacctaatttgatgtaattattagcttccagactctctgttacaacactgttgttctcatcgatataaacagctccattggcatctctcttcaaatccatcaaggagtaaatgtcacccatgcttccaccttctttcaggatgaaacgggtactacccagaccacccatattcagagaagaaatagagaatttctcgcgagtgataggattgatggcattatcagctaaggtaagaatcttattcttgttcattgaataagtaactcctgtattccaagtaaaatctttccatgtattattgtaattcaacgctaactcaagaccttgattgcgaactgcacctgtctgaatgtagatacgagcatattcacctaccggcaactcaggattgaatgtctgattcattgtcttggcgttataataagtcacatccagttcgaagttcttaagaaaacgcatattcatacctacttcaaaagaattggtacgttccggtttcaagtcatataccgggaagtcagtcaggttactccactgaccgatactggtattccatgcgaacaaaggattagctatatatctttcgaatgctgtacctacagaagcaaaagaaccgcgtatcttccagtaagacagatagtccttattcaatttaggcatcaattcagataacactacagacatacctaccgaagggtagaagaatgatttattgacagagttacggcctgccaactgtgaaggccagtcattacgacctgtcaatgtcagataataagtactttggtagccaacttcggcagatgcatagatagactgagtctgttcacgccatcctgactgcattttgcttgtcttggtcgtactcagattttgaatatagaaaccgtttgtcaatccggctttttcaccagcaaacgtttttgaatcatcagcaataggtccgcgtacagccatttcatcatatcgcatatcagtaaacgatccacccatattagcttgtaaagaccatttttcaccgaatgttttgtttacacttaccaggaagtctgcatacaactgcttttcgtagcttctggaaatgccataaagaccacgatctgacaactctgtcagctgagtatttgtactggcataagccttttccgtataatcattgttagaattatccaggcggacacgtccggaaacatttaaccagtcaagaatctgataattcagacttgcacctaacatatagcgatctttcttattttcacgcaagttacggtagttcacccaataaggattctgcatagtcatattaccatcacctgtcggccagtactgagtatagatcttacgtgcaacgtcatagcgttcgtacattttaatatcttcccagtcattaccacgagggaacagataagctcctaccaacggattgttgtaagtaccctgattcaccatattgcggtctttctgcaaaatgtagctggcatttacatccaatgtcatcttatcatcaagaaatgaagtagtattgcgtacgttgaaattataacggtcatatttgttgttaggaacgataccttttgaattaaccgctgcagcggaagcataagtctggttcttttccgaaccggtagagaatgatacgctttctgtacctataacaccagtctgaaaataatcatcacgaggattatatccaaaatatctggcttctgtcagtttagggccccagctacgactggagttatcatctttcacgccaccaatacctgtaccataacgtgtctggaaacgaggcattaccaaaggagcattaaactcaacattactattcactgtgatattcacacgaccttcttttccttttttagtagtaatgataatcgcaccattggcagcatcagaaccgtaaagtgcagctgctgccgcaccagtcaacacagacattgattcaatatcttccgggttaatgtcggcaatcggctcagtatttcctttagaagaaaactctgtcccattcactttatttgcattggagtacatcggaaccccatctactacatacaatgcattggaagactgcatgatagattttgtaccacgcatcactactttagatacaccgcccactccggatgaagaagcattgatattaacacctgccactttaccactcaatgagttaataaagttaggatctttattggtagtcactgcatcagcatttacctgctgtacattgtaagacagcgctttttctgagcgtttgattcccaatgccgtaactacgacttcatccaagacttgagcatcttcctttaaagtgatattaatagcagtctttcctgctacagccctctccaaagtttgatatccaacatacgaaaattgcaaaactgcatttgaacctgtaacgactaatgtataattaccatcaaaatcagtaatagtaccattagttgttcctttttccaatacagaaacgccaatcaaaggttcgttattagcatctaccaccttacctgttactttctgttgttgttgagtcgactttgtcgaagaagatgcatttgctttcgacaaataaacaacattgtcatcaattttataaacgacatttttccctttcaaagccttatccagtacttctaccaaagaaacatctttaacattcaatgactctattcgcattgaagccaaattgtcatcataaaaaaattgatacttggattgagactggatttgcttaatcacagttcctaaagaagaattggagatcctaattgttaactgtgctattgcagattgtgccggaagggcgaatagcatcaagatcaacaatgcccgaaaaatcttcgagcctctacacgagtcattgattctcatacacttgaatttaagattaaacattagtttttatataaatattagaatcgatattccatttattattttcgattcacatttatataacaacccataccttgaaaaacacttagaggtttttgaaaaaaaataaatataatctcatatttattttttgctgtctatttttagttgtctattttattgtatgatttttatgttcagcactttctctgtgctattttagtatcatgtgaactactacaaagatagcggtttcgatgaataaagaaggaaaaaaaacgttcaatctaagaaagaaactgttcattactctataaatactaatcggattgctgtttcatgttgataattctttttatcaaaattcgtttgtactgaatgagaaaggctgccttatttttattgttgaatagattttatcattttttgaatagaaaatgttcgtgtttctattgttttttgtcgttctttgtgtatcacattaaacaaaatctaatcaatgataataaatagaattatgagaacacttattattttgcttttatgcacgaacacgagttttgcgatagctcagatttctcccaaagcagttgagaagaataaccaatctgtgaaaactgcgggtttctttaatgattccgattctttaaataaggctattcatctttcagatgaggcgatagctttggagccttcatacaaactggcatatgcaaataagattaaatacttaatggcgttgggacagaaggagaaagcactgcaaaccatgttgcaaatggagaaattctctccggatgatccttactatattttaggtaagggaatgatgctggaagagaatgctaaaaagagcctggctatggatgcttacaaacaagctgcctctcttttcaaaaaacgcttgaaggagaaaccaactgaagcagacctgatgaattatgtattcgtactctttttgagggataacaaaaattattctttggatgaaatcgaaaaggagtatccccaaatcttcagtccagcaataagacaacacacgaaaaagttgatagatgaacttagcaataaaagagaggatgtaattcatgagatgctaggtggtaaatgaaaacatagggattgcgggtggtttacttcattcctattttgttgatggagctattctgaatgattcttgcacgctgtttgttccggatggtgtttctccgtcagaatatcgtcagtctgatgcttatcaacaagcatccaagaatcagcaggagcatggtggctctcttagccttgttgccgattcactacaatatgcgtatatgaaagctcaggttgagtatataatattgccgtttaagaaacggttggatggcttcacatattggcaaagagaattggaaccggccattcatccggccttgaaagcgtatgtcaaagcggaaaatgcgacaggaggagtttcttcggttatgatattttgggaaattgccaggaacacggatcatttttgcagtgattttaaaacagatcgtgatgtgcgaatgttcctgacgctttatttctggaaatatttgtgttattttgcaaatatagatttttataccggtcaggataaaactgaagagattctgaagggggaggctgattagtttggaaatctgattattagtttaaaacaagaaccattaatgttatgaaattgagaattgtacatttgttattattgcagtccgtaatgcttcttctttcctgttccaatcagagccggaagaatatggatacatcggcagaaccagctgacgtacaggcgaatgtgtcggacagtagtagaattgaacaagaagccatcggcatgattgaagacttttatgaggcttatgctgccagtttcatgtccaccggtaaagaagctctcgcacttggggattcaattaagcaaaagtttctgaccaaagagctgatagagaaagttgataggctgatagaggcgacagatgccgatccgatcattcgtgcgcaagatttaggtgaaaatgacatgaaaacattgtcggtgaaacatctgaatgataattggtatgaggttaactatacttcggctaaaggcagccagtatgaacgtgccgtgagtatcccggtcagagtggttaacgttgacggacaatatctgattgatgatataactccggaaaactgatcgtatcattaaatgatatgaaaaaagacaaacagcatcttttacgctaggcaaaagggctgtttgtctatattcaacgaggaaaagagtattcgttttatttctgttctttgactttttccatcagtagcttcatgtagtagccacctactacggaacgtgccttgaaattcatcatctttcctgtattcgtatcatgccagtcgctgataggcacacgggaagttgtttcgttcgcataagtatagatcgggtcgatgaacttttggaacgtagcatcgtctggagacatacaggcactccatagtacccagtcggatttggtatattgtgcgcgggagtccaatagcaaaccatatttattttgcttggtcagatagaaaggaatttccgtatcaaatactttctgcgggaaaatgttcatgttaaacactttgtcccatatcagattgtatttctgactccacgttcccggtttgtcaaatgccagtttgtagtgatcgtcgtcaaatgccatcttctcccattctatcgccagtcttttggcggtttcgatgtatttgttcgcagttgtttctttgcccagcatacgtgccatttctccgtatccggcgattgccatgatcgctttggcggaaagattggcattgtgtgccagatgtccggcaaagtcatctgtacaaagttggttttcagggtccagaccgttctcaatcagatagtttgcccatgttgataatgtttcccagtatttggaagcatagttggcattgccttccatcatagagatggctgtagttaccagaatcatgtttccggcttcttcgataggcatatcttcaccataaagttgcccgttggctattggataagttcctaagtcatgagcggggtaaggcttgttccagcgtccgctttcgctgtagtagaagatagagttgagcattcccttcatcagttccgtattgtaaataaggtatagtggagcggatggataagttaggtctactgtgttgatacagccgttactatggttctctttggataagaaaagcaggttgccttccttgtcggtaaggagtttatgggcggtaatggagtggcggtaagtcaatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgaccgttgtgtttccagtatgccatgcggcgttcgtagaaatattcgatcgagtagatatcgtcgtagcctaacatcacatatccgcttttcccttgattgtctaccttgcctaagttttcggtataagccatggcgggcatatcgctttcgctgcgggtgatgaaatcctgggagtttggcaatagtttgccgttggtgatgaaggcttgcttcatgtcatagtagttacctatgcttaagtccttgttgggtgcgctgttgcttcccagataagcatatccccagtcgatgcgtacaccgtctcctttacgttttacgtaaggctggtcgatggtacctgccttgaggtaatccattccgtttttgctgatcttttctgagatggttggttgtgacggttcgtgtacggcaagttgcggggttgtttcgatatacacttgcacatcatgttgtttcttgtcgagtgaacgtacccgataggagatgtagttgataggggtcgagataagatcaagatcttccatcagcagaggtgctgtgaatacgagatccagttctaccggaccgcaggtgaatgtatagtaggtctgtgtcggtaatacatcgacagacttctggatagcagcttccttgaagttgctgagctgtttgttctcacggaacaggccgaaatcaacgtatgctccgccggttgtgttgtgacagtgtgctgcaataatgtttgttcctttacggagcttggctttagctgatgcggatagttcgatggtaacatcgtcattccaggaataatcggttgccaccagtttttctccgttcagatagagctcgaatacatcgtcgtgtgaataacgtaagtagataatgtcgtttgtcaggtcttgattgaggttgaaactacggcgtacccagatgtcttcggtgttccactctgtgccgatgcgtttcatgtctttggtgccgaaagcggctttgcccttggtccatccggaatcatcgaactggggctgtatccagttggccgccggttggctcatggtgaactttgcttcccaacgttcggtgtttgtcatcggaaggattgtttcgaggtttagcttgtccttgcccatgaaacgatatactttcccgtccacccggagcgctcccagtaaaggatgggtggcggctgtccagtgttcggtgttcccttcgttcagttcgttgtagggagaccagatagcaagataagtgtcggaagtgatcagaggtacggacggtgcacgcaaagcgatatcctgactcgttttaaacaggtcagttgcctgcacattgcatgcgaggcaaactgacatgattgtagagaatagtttattcattaatatgaaacttttatttatttagcgagttacaaattttctggttgatggctttgattttaggctcgtctactttaataactttccggtcgtaagtaaccagaccgttcacttcttcttccacatctgtgatttgtgtgtatacggcagccgagaagcctttctcgatcagttccaataaatggtctgcatattttatgtattcattagtcacttcttccggcgtgttgaacttcacgtagccccagttcttgtctgccagccacagatgtcctttcagtgccatacctataccgccatattcgcccagtacggtagcgcgtatcggatcgtagagatagaggttcggtccgggatagttatgaaggtcgagaatatctccgcacgtgtagtggttacctccactggcagggtttaccagacggctggggtcgtattctttcgtccatttagtgatttcaggagtcttgaattgtccccatgcttcgttgaaaggtacccatacgccgatgctcggataagaatacaggtagtcgataatttctttccattctttgcgatagttagcttctgatgctgcggagcggatggcgtctgcgccgtcatagtacttgtgcatctgccattcggcaggaccgcgacctccgttcggcatatcttgccatacgatcagtccgagttggtcgcaataagtataccagcgtgccggttctacttttacgtgcttgcgcaccatgttgtagccgaaatctttgatcttcttcaagtcatataccaatgcttcgtctgttggcgctgtgtataagccgtccggccaccaaccctggtcgagcggaccaaactggaaatagtctttgttgttgagttgcaggcgtgtaataccattcttgtctttatgagttgagaatttgcggagagcggtgtaactcttcacttggtctacagctttgccgtctttataaagagtgacttccatattataaagtgaaggagactcgggtgtccataatttaacgtcttccggcattgttaattctaccggtacgccattgagcgctgctcctttggctacgaggtttttgccgtcgaatactttcacttccactttgtctggagagcatacgttggtggctacttccactttgacagtcttcttgtcgatatccggagttgttttcagttgggcgatatgctgggcagctaccggttccagccatacagtctgccagatacctgtgactggtgtataccagattccttccggtctttctacttgttttcctctcggctgttcgccacggtcagaggggtcccacactttcacaaccaactggttattgcctttattcaatgcggaagtaatatcaaagtagaatggagtgaagcctcctgtatgttgtcctacttttacgtcatttacccatacatcggctttccagtccacagctccgaagtgcagtaatatttgtttgcctttccatgctgacggtacatcaaaagtacgctgataccataattcctgatgctcgttaatggttttacctactcctgacagggaagattcgactgcaaaaggtactaaaatctctccttggtaattgtttggtgccggttctccttttttagtaatcgcataattccagctaccattcagattcttccaatcctggcgttccataatggggcgtgggtattccggtaatacgtttttaggattcaactgctcaccccacggagtctttatcttatcaccggcgggcttccattgagcgaatgtcgggctacaaagagccaatgcgaatagcactgctagaaaattctttttcatggtaattatctttatatgtattaaatagaagaattaatattcataaaaggaatattgcaaagaaaagctaatcagagaagaataaaggaaatttgctgttcaataaatgataaatgctcgtcattttatagtgaatgacagttttttatgcgataatggttattttttgtccttaattgaataataagtagcttatattaccggagataattatgacttttggagggagaacaatcgtatgtttccgcggatagtcgtaaataaactgaaaaacaactataataaactttatcaatgagaattctttttttattagtagtattggtgttatgaaatatagattaagaaaaggaagctgtttgtgaaaatcgctccaatattgtttgttttgtttgtgttatcccattttggtgccaagagtggttttcaaaatgggatttttttgggctgattaaaaagtcggtagtatcttaaatctcctccttcgggaaggaggagtacccgcagggggaggtggtaggtgaatacgcaattctttcattcatagtaaaatagatacaaccttgttttacctaccaccccggctttcagccatcccttcccgaagggaggggaattggagatactattgcctttttagttagtccctatctagggtttctttaatgatgcccgttttatttacctcttccgtatctttaaaatcataattttgtgggaactagtatattctcatatactttgggcatggaataaattctctgaaagggggcaaaaattagaggaagcaatagattcggttccgataccggatataaaaaaaaggttgtaacaacttgtgttacaaccttttttgtggaccagcctgggcttgaaccagggacctccagattatgagaacgacaaagtgatattctgcgatggtcagttttctcaatatttactgtgtatcaaacaattacgaatttagctatctcctatgaaactcactaaatccccctaactgaaaccgtttgtttacgcattgtttacgcaggtttgaaaagaactgttgtaattattctcgtttatatctgtttgtataggctatattttgtcgcaaaacagtttttttgcgacaaacctatactaaaatgtcatctttagcttcctgtctttaaatcatagacttagcaattacaacttttacaaaatctacttttgtctctttcgaattcttctttaattctataaacttggggcgagttaggataaacaattaacgtttcttgtatcttttcttttatttcttccttagtgtggtttctagatttaataaagtattctaattgcattgatgctaaaagttcatccttacgtttactaaaattctcttccatctccttaaggaggcgattaagtgtatcttcagtttctgtattccaaggataatgatttaataaacaacgaaaatatgcttctatatgataagaattggtcgatttacgattataattctcttttgccaaaggaagggctttagtatatttttcttgattcagataaacattcactaactctcgtcttgcaatttgcatattagaattaaaatctaaagccttaaggagatactcctcggccttggaatagtcctctttatagcgatagtaaaatccatacagaaaatctttactacctttatctttaattttgtcaatgtatgtaaagaaaattctatctttcatacgagctaaaacttggcacaacctatagtacaattcttgcagaggttcctctgtataacttgaacaatgttccaaagcatgcaaacaaatatcttttactgaatcatagctaccctgattataaagatcaatgactgtacttataacgatagacggcatgacatacgcaaaacctttgccagacagcaactgcttccgcaagtcatgtaaaaatattgataattctcctagatcatcttctgccgtatctattttattgaagattatttcttcaatacgggttttcattataggatctaaatctaatttacttctacgtatataatctgaaacgccaccgtccaaactaatattattgcctccaggaccgtaaaaatctaaaatagacaaagattcaaaattatttacgagctgttctattttaggataatcttcctcatataattgttcgagtaaatcgaaactgatcatatcaacttcagcaagcacttttgctaaagtaagagcagtctcatctcctttaaaccaactaataactctggaaaagacttcatctcctattgcaatcaggtttttaatgtctttcttagcaaatcttacgttcttatctttaatttctcgaactgcctgttctagttgttggggagaggactgaagacgatccacaaaaaaatcgacatcactatcatttagttgaacattataataacgacagcaatttacaaaaagacgtttgcgttcatcttttgtaaacccagaaagatttatatgaattatctggggatatgctctcaactcagaatatctaggcttaaccctactacttataaatatctttaacgagtctatcatggcaggatgggatataatttctttaccccattcagaaatagttccgtcatatgatacaaaactcatctcatcttcaattagtaagaatgaatgagcgttgattatctgattaatataagatacacatttagtaatttgatgttcatgatctaatttaagaatatcctcatatgatgctttactaaagcccaagccttcgtgcaattgaagtataaagttgtctaaatatgttttttgaggtagttttatctgaaatccttcagggataaatgatagtccgctactgtcctgaatacatttttggataaatctagtacgcccacttcccggttttcccgagacaattaaagaacgatgaggcatatacacactgtcgtacatcgctctttgaaactcatctaattcattactacggccaataaacgtatttatccaattgccatatgcattattcccgacacaacgaatttttcgttgtgtttcaataataaactgacctataattttgggggatgttattgtttttatatttaaactccagtcacgagtcatccatgaaggtaactcttctaactttactccttcttcaattataaaaggcataaactctctaataacacctgtgtcataaagttgtcgagcttttgacatttctaatttaatccaatcagactcaagggcatctttagaaattagtaatacaaaaatcggcgcaaagtttagatttctaactatttcatttaccgtttttgtcgctggataaaaatcgaactcgtcaacaatgcaattgtctcgttttactgtgtcaactatttttctaacaaaatccttatgagtacttctatgagatatgaatgctacggttgattgcatattactggtgtattaaaatcattattaatgctgcaaatataataaaacaaactggtttgttgaatataattcactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaagttgaatagaattaaggctgttttatccgaaaaaggtatttctcaaacatggctggcaaagagacttgataaaagttttagtatggtcaatgcctatgcttgtaatcggattcagcctaatttagatactttgcaactgatcgctgagatattacaagtagaccttaagtatttgataaccgacaaaaaggataggtgagatgaagcagttttcagaagcaaaactgtgtggcttttcctgtacttgtcgaagaacaaaaaagtagtaagtggctggcagaacaattaggaaaagacagggctactgtctccaaatgggtgacgaacactatgcagccagacgcaagaaacctcctacgtatagcagaggctttgaatattgatgcaggtagactgctcaaccaaaaacatttgaacaatgaaggaaatagatattatccaacagataaaacttggcgaggtcagtaaggtgcagttcaaagaacggctccttgacaactatgacatcggttgcgaactggtggctttcagtaatgcacgtggtggcacgttggttgttggtgcggtagataaaaccggaaacatcaatcctttgtcctatttggaagtacaggaaaccaccaatacacttagcaatatcgcatctgagaatgttgttcctgccatccttgttgatgtggaaacaatttctgtggatggcggaagccttgttgtggctcatattaaggaaggattgaataagccctaccatgacaatcggggaattgtgtgggtgaagaacggtgctgacaagcgcaaagtgttcgacaatgccgagcttgccgagatgatgactgactgtggcagcttttcgccagatgaagcaggagtaagagatgctaccatcaaagatttagacgagggtaccatcaaaaccttccttagtaacaagtttgataaggtgttagcaagaaaaggcttggtgggcgacgcatttcgcgaagcctctttagataccgtctgttctgctattgccagtgggcacaatggagagaaactgttacgtaacctgcgttttattcgtcccgatggtaaaatcacagtggccgcgatgttattgtttggcaagtacacccaacgttggcttccaatgatgactgcaaaatgtatttgctttgtaggcaacaatcttggcggtactcaatttcgcgacaaggtgaacgatgccgatattgagggtaatctgcttcatcagtttgagactattatggatttcttcacccggaacttgcgtcatatacaggttgggaatgagtttaactcgcaaggcgtgttggagattccttacaccagccttgttgagttcaccgtaaatgctttagtgcatcgatcgctgaatgcgacagccccaatccgcatattcatttttgatgacagggtggagatacacagccccggaattctccctaatggacttaccgtagatgatattgttataggcacatccatgccacgcaatatgttcctattcacaaatgccatccacctgcttccctacacaggagcaggtagtggtatgcttcgtgccttgtcggaggacgtgaatgtctcgttcaccaataatgacaggactaatgagttcgtgattactataaataggcagataagtaatcaacccaatgcagactctgacaccgacttagataccgactctgacacttttaatgcggactctgacaccaaacttagatactctgacaccgacttagataccgactctgacactttcaatgcagactctgacactatacgtcctaaaataacaaataagcagagggatatagtaaacttctgcagtgtgccacgtagcagcaaagaaattcttgaaagggtaggtgtgacataccatagtaagaatattcagacatacatcatgtcactaatcgaggctggctatctcgaaatgaccaatccagagcatcccaatgccagtaatcaaaaatataggagaagtaaaaaatgaactcacatatattcactaacaagaacggcaacatactgatgcgcgaatttgaaagagttcttgatttcattataaacaaagacaaactgtacaatagtctctaaaaaaacaacgatatggaatacggaatagtttatcttctgacaaaccctgtgatgccaggacttgtaaaaataggcatgaccacacaggaaggcattgataaacggatgaaggaactatataccacaggagttcccattccgtttgagtgtaaatttgcgtgcaaggtcaaaaaaagtgattgtctcaaaattgaaaaagcccttcataaagcctttgaccctcagcgcatcaaccagaaccgtgagttcttccgtatcaacgtggagcaggcacaagccatcctcgagctttttcatcatgaagatgtgacggaagaagtgacggatgagatacagaatgacctcaccgatgaggataaagctgccagcacaaaagcacaagccaaacgtccaccactcaacttctatgagatggggttgcagaaaggcgatattctcatatggaaagatgacccatcaatttctgttaccgttctttcagagcgtaaagtgtgttatgaaggagaagaaacttctattagtgcgctttctgctaagctaaaaggatataaggtcaagcatatacagcccacaccgcactggtttttcaacgaccgttctctaagtgaaatctacgacgaaacgtatccatttgaagagtgaaggcatatataggctgcctctaagtttactcatgagtgtggcaaggatatgccaagagcaggagaaaaacgaaacaaaaaagataaacgaaatattcaaaagattctaatgtattatggcaacgtggcaacatacagacatcatcgttgtgaaaaaatatagcattagtgcgactattgggtaagtttgttcaatcgcattacgattgaagtttgacttctgcccattttggcagcgatgtattttacgctcttaccttcattatgcagttctaataaaaactggtctgcacgccttgtccatcttttattagcattggggtgttttacatagctttcttctgataccttttcaggatgcaaaaactcatctacaaatacagatgggaaacgcttgtcgtatagcacaagtgttttcaactttgctctcgttattgcaacataaaacaacctcctttcttcaccatatgggaactgatcacttttagtcaggacataattaagcacagggtcatcgcttacaagtgatggaaagccataggtatctttattacattgtaaaagtatcacataatctgcttcaagaccttttgatttatgtactgtcaagaactcaatttttcttcctcctattacatagtaaaatctattaccttcttttatcccttgatacataaatgacaagtaataatcatcaaaagaatagcgtcccaataaaaatatagatttatccaatggaatagaatctataagttctcctattgttttgcagtaatcacgtctgtcgtaagaacaaaactccaattctgttttcatatcagaactgaatgaatgtatatctttttttatttgtgcgttattacgttgaataaaacgagatgataaagagaccaaaggctctccaaatctatatgtggtttctatcttatttatctctgttgtaccaaaatattctggaaattgattaaaaagagccatatcacttcccgaaaaacgatatatggactgccaatcatcacctacacaatacaactttgcaggcggatttccctctctcaatacttttaagaagttgtaacggtcaaccgatatgtcttgaaactcatccacaatgatgtaatcatactcaacaagatgtgtagtacgacatatctctgtggcttgaagaatcgcatcagtaaaatcgatttggttactatcgcttaatgcacttttataacgttcatatacaggttgaaatatgtttttgatgataaaaacacttcgttcatcacctgcattctttgcttgcttcagaacttctttaactgatttacaacttgattttaccaatgttacgaaagtaactacaagccgtataaacgctttttcttgcttactacctttgggcaaaaccaaatcatataattcttcgtctgttttctcttgaattggtacgcccacatctgttaatatttttttgagtttatcttttatgtcagaataatggaaatctgcgcttgatgtcactaaaagctgagtgccaaatttctcatgagcagttttcttccaagttataccatcattatatttttgattggcttcttcgtatgttatattcttgtcttttgcaaaccaagctgggacaagaccgtgttcatcaactccgaaatgttccaaatagattcgtttgggtactcccttttgctcgaagtatatagaaaaatcagggcgatattgagagtgcatttcatctgccaattgatgttcgtatggctcttcatatctgaattgcactccaagagatgataaaacaaaacatatcttttgttcctgttcacttctcacatatatggttctaccgtccatatcgggaaacatcgcttttagctgtacattcttttgctctgacaatttttctcgcctttcattcttgcgttgttcccaatctgcttcattggtttggtagtcgatgaagtattctactacacttttcttaaaatcctcattccctaatagagtgtgataaatatctataaataaggcatcagtattatcgcatatagaaggtttaacaccagtttctttttcgataatatcaatggctaatttatgaaatgtatagcctttcaaaccgttggtagccattctctccgttagttcggctgctgctttgttcgtgtaactaatcagtaagattctatgaggggcaatgtctttgatttctgttagatacttgacttttccaacaatagaagaggtctttccactacctgcactactaaccactaaacaattatcttcctctgaaacaattgaacgtctttgctgtttatccaatggatatttcaaacaatggtcgaaaaaatccttgtgtgtatcaagtaaggaatttattaccgtatcattatgttgtttgacaagcctcttgatattaccaaagtcacgaattaggtttgagattgttacagatggcgtgatattgaaagtttcaagtttcttaacaagtgaatatgcttcttgaaaatatgatatataatgatttgtgaaatccttttcttgcgctgccgatattatcttaccataaaaaacattgtttaagtctgccggaatatcaataaatacagcatcgttaagtttagacagcctctcttgggcttgctcgtagctggacttctcactataagcggatatttgaagcaatttttctgttaattctttggatttgtttttgaggtgcattcgtattgctactattataaaaagagcaacaaaacaaatcaaagctatgaataaaactaactgcatatccgagaataatagctatttaaatttctcaatccacctataatcatcccctttggtactccattggaatttccacatatctcctgtattatcatttatgagatagtattgatacatacttgtcaatggttgaatggagaatatacatttttcgttatcagaaactaactcatatttatttattggtatgcaaaatagattatccaaatcttgtgtactatattggacttgccataatcgcccattatacgaatctaatagtataaaagtccacatattttgagttctgaacatctgaaacctattactccaatttgaagttgtttcaggatatgcaagagagaaaatgtttatcggtgcagcaaacatataatcttcgccttttacactaaattggacttgccaatttttacctgtatatgtgtcaagcattataaaagtccacatattctgtgtctcataaaggcaaaatcttcctactttatcccctgaagcttctctcgcactgcaaatttcccaagattgaccatcatcttgaatttgttgtacttcacctgtcatcgtatttaaacggagttggttatggtaatttctcgtagaatacattttataggtttgggcatacgataccaatgtaataaccattaatgcacatgatacaataagttttttcataaattgttgtattatttgattattaattggttttatttctttgggaataaagttgataatgctcttctaatggcttgacgaatatcatcggcttctgtttcaccttgtccttctgccgtacaagagcatatcatttcattggtttttgcagaattaaattgtatggttacttctatggtatatcctaagcctctattacgcctaccactctcaccataattaacgattaaagtttcattagctaattctggtttaagttcgggtaatataacatatccctcttttattagtattccggctattacatcactcggattaacacttttggtggttgaagaaccatagatgccatattgtcctccatatgtacctcctgtacttgatgttaattcctttgtcggagaaatgtatgcgtatttatacatttcaacaggggcattcctgacgattacaggcattcgaagtggtgcacatccattcatcaatagaatggcgcaaatggctaacaaccaatttttaattatgttcatacactacacatttaatctccagtcccatagaggaatttaacctacataaaagcgtggaactgtatgccacactcttacttgaaggtcgtaggaaaccttggatacggatgtaacaatagcagcccacgctatagcgtgagaaccactatgctatccttgtatccaatttgaaaatttcctacgttttcaagtacaagataagcataacgcttcttctttttctaatatgtcttggatagagtttcctccaatccaattgcaaaggtacgaaaagtatttgatattcgatggtttatacaggattaaacttatctcgtgatatgtattgtttgctattattgatacaggtctattaatattatgctttacagacgagttttcaagtaataagaaataaatataagcagaaaacacactaaaataacccagcaaaacactttcgccc
